(12) United States Patent
Baker et al.

(10) Patent No.: US 7,220,835 B2
(45) Date of Patent: May 22, 2007

(54) SECRETED AND TRANSMEMBRANE POLYPEPTIDES AND NUCLEIC ACIDS ENCODING THE SAME

(75) Inventors: Kevin P. Baker, Darnestown, MD (US); Audrey Goddard, San Francisco, CA (US); Paul J. Godowski, Burlingame, CA (US); Austin L. Gurney, Belmont, CA (US); Daniel Tumas, Orinda, CA (US); William I. Wood, Hillsborough, CA (US)

(73) Assignee: Genentech, Inc., South San Francisco, CA (US)

( * ) Notice: Subject to any disclaimer, the term of this patent is extended or adjusted under 35 U.S.C. 154(b) by 311 days.

(21) Appl. No.: 10/160,502

(22) Filed: Oct. 19, 2001

(65) Prior Publication Data

US 2003/0190703 A1 Oct. 9, 2003

Related U.S. Application Data

(63) Continuation of application No. 09/918,585, filed on Jul. 30, 2001, now abandoned, which is a continuation of application No. PCT/US00/04341, filed on Feb. 18, 2000, which is a continuation-in-part of application No. 09/380,138, filed as application No. PCT/US99/05028 on Mar. 8, 1999, now abandoned.

(60) Provisional application No. 60/094,651, filed on Jul. 30, 1998.

(51) Int. Cl.
*C07K 14/435* (2006.01)
*C07K 14/52* (2006.01)
*C07K 14/715* (2006.01)

(52) U.S. Cl. .............. 530/351; 530/399; 530/402; 530/350

(58) Field of Classification Search ............... 530/399, 530/351, 402
See application file for complete search history.

(56) References Cited

U.S. PATENT DOCUMENTS

| 5,648,376 A | 7/1997 | Strobel et al. |
| 5,801,193 A | 9/1998 | Ojo-Amaize et al. |
| 5,817,306 A | 10/1998 | Haskill et al. |
| 5,958,403 A | 9/1999 | Storm et al. |
| 6,586,228 B1 * | 7/2003 | Parham et al. ........... 435/252.3 |
| 6,610,286 B2 * | 8/2003 | Thompson et al. ........ 424/85.2 |
| 2003/0175778 A1 * | 9/2003 | Ni et al. ....................... 435/6 |

FOREIGN PATENT DOCUMENTS

WO WO 99/46281 9/1999

OTHER PUBLICATIONS

Kahan Cur. Opin. Immunol. 4: 553-560, 1992.*
Piccotti et al. Transplantation 67: 1453-1460, 1990.*
Campo et al. Biological Trace Element Res. 79: 15-22, 2001.*
Manual of Clinical Laboratory Immunology, 6th edition, Ed. by Rose, Hamilton, Detrick. ASM Press, Washington D.C., 2002.*
Basic and Clinical Immunology, 8th edition, Ed. by Stites, Terr, Parslow, Appleton and Lange. Nonwalk, Connecticut, 1994.*
Guidebook to Cytokines and Their Receptors. Ed. by Nicos A. Nicola. Oxford University Press, New York, 1994.*
Spencer et al., *J. Exp. Med.* 187:571-578 (1998).
Kotenko et al., *EMBO J.* 16:5894-5903 (1997).
Jaramillo et al., *Cancer Investigation* 13(3):327-338 (1995).
Gamliel et al., *Scanning Microscopy* 2(1):485-492 (1988).
Einhorn et al., *Med. Oncol. & Tumor Pharmacother*.10:25-29 (1993).
Ringenberg et al., *Missouri Medicine* 85(1):21-26 (1988).
Saracco et al., *Journal of Gastroenterology and Hepatology* 10:668-673 (1995).
Gonzalez-Mateos et al., *Hepato-Gastroenterology* 42:893-899 (1995).
Malaguamera et al., *Pharmacotherapy* 17(5):998-1005 (1997).
Langer et al., *Immunol. Today* 9:393-400 (1988).
Fung-Leung et al., *Transplantation*, vol. 60:362-368 (1995).
Shim et al., *Proc. Natl. Acad. Sci. USA*, vol. 99, No. 16:10617-10622 (2002).

* cited by examiner

*Primary Examiner*—Christine J. Saoud
(74) *Attorney, Agent, or Firm*—Elizabeth M. Barnes; Mark T. Kresnak; Ginger R. Dreger

(57) ABSTRACT

The present invention is directed to novel polypeptides and to nucleic acid molecules encoding those polypeptides. Also provided herein are vectors and host cells comprising those nucleic acid sequences, chimeric polypeptide molecules comprising the polypeptides of the present invention fused to heterologous polypeptide sequences, antibodies which bind to the polypeptides of the present invention and to methods for producing the polypeptides of the present invention.

6 Claims, 237 Drawing Sheets

FIGURE 1

CCAGGTCCAACTGCACCTCGGTTCTATCGATTGAATTCCCCGGGGATCCTCTAGAGATCCCT
CGACCTCGACCCACGCGTCCGCCAAGCTGGCCCTGCACGGCTGCAAGGGAGGCTCCTGTGGA
CAGGCCAGGCAGGTGGGCCTCAGGAGGTGCCTCCAGGCGGCCAGTGGGCCTGAGGCCCCAGC
AAGGGCTAGGGTCCATCTCCAGTCCCAGGACACAGCAGCGGCCACCATGGCCACGCCTGGGC
TCCAGCAGCATCAGCAGCCCCAGGACCGGGGGAGGCACAGGTGGCCCCCACCACCCGGAGG
AGCAGCTCCTGCCCCTGTCCGGGGATGACTGATTCTCCTCCGCCAGGCCACCCAGAGGAGA
AGGCCACCCCGCCTGGAGGCACAGGCCATGAGGGGCTCTCAGGAGGTGCTGCTGATGTGGCT
TCTGGTGTTGGCAGTGGGCGGCACAGAGCACGCCTACCGGCCCGGCCGTTAGGGTGTGTGCT
GTCCCGGGCTCACGGGGACCCTGTCTCCGAGTCGTTCGTGCAGCGTGTGTACCAGCCCTTCC
TCACCACCTGCGACGGGCACCGGGCCTGCAGCACCTACCGAACCATTTATAGGACCGCCTAC
CGCCGCAGCCCTGGGCTGGCCCCTGCCAGGCCTCGCTACGCGTGCTGCCCCGGCTGGAAGAG
GACCAGCGGGCTTCCTGGGGCCTGTGGAGCAGCAATATGCCAGCCGCCATGCCGGAACGGAG
GGAGCTGTGTCCAGCCTGGCCGCTGCCGCTGCCCTGCAGGATGGCGGGGTGACACTTGCCAG
TCAGATGTGGATGAATGCAGTGCTAGGAGGGGCGGCTGTCCCCAGCGCTGCATCAACACCGC
CGGCAGTTACTGGTGCCAGTGTTGGGAGGGGCACAGCCTGTCTGCAGACGGTACACTCTGTG
TGCCCAAGGGAGGGCCCCCAGGGTGGCCCCCAACCCGACAGGAGTGGACAGTGCAATGAAG
GAAGAAGTGCAGAGGCTGCAGTCCAGGGTGGACCTGCTGGAGGAGAAGCTGCAGCTGGTGCT
GGCCCCACTGCACAGCCTGGCCTCGCAGGCACTGGAGCATGGGCTCCCGGACCCCGGCAGCC
TCCTGGTGCACTCCTTCCAGCAGCTCGGCCGCATCGACTCCCTGAGCGAGCAGATTTCCTTC
CTGGAGGAGCAGCTGGGGTCCTGCTCCTGCAAGAAAGACTCGTGACTGCCCAGCGCCCCAGG
CTGGACTGAGCCCCTCACGCCGCCCTGCAGCCCCATGCCCCTGCCCAACATGCTGGGGGTC
CAGAAGCCACCTCGGGGTGACTGAGCGGAAGGCCAGGCAGGGCCTTCCTCCTTTTCCTCCTC
CCCTTCCCTCGGGAGGGTCCCCAGACCCTGGCATGGGATGGGCTGGGATTTTTTTTGTGAAT
CCACCCCTGGCTACCCCCACCCTGGTTACCCCAACGGCATCCCAAGGCCAGGTGGGCCCTCA
GCTGAGGGAAGGTACGAGTTCCCCTGCTGGAGCCTGGGACCCATGGCACAGGCCAGGCAGCC
CGGAGGCTGGGTGGGGCCTCAGTGGGGGCTGCTGCCTGACCCCAGCACAATAAAAATGAAA
CGTGAAAAAAAAAAAAAAAAAAAAAAAAAAAAAAAAAAAAAAAAAAAAGGGCGGCCGCGACTCT
AGAGTCGACCTGCAGAAGCTTGGCCGCCATGGCCCAACTTGTTTATTGCAGCTTATAATGGT
TACAAAT

FIGURE 2

MTDSPPPGHPEEKATPPGGTGHEGLSGGAADVASGVGSGRHRARLPARPLGCVLSRAHGDPV
SESFVQRVYQPFLTTCDGHRACSTYRTIYRTAYRRSPGLAPARPRYACCPGWKRTSGLPGAC
GAAICQPPCRNGGSCVQPGRCRCPAGWRGDTCQSDVDECSARRGGCPQRCINTAGSYWCQCW
EGHSLSADGTLCVPKGGPPRVAPNPTGVDSAMKEEVQRLQSRVDLLEEKLQLVLAPLHSLAS
QALEHGLPDPGSLLVHSFQQLGRIDSLSEQISFLEEQLGSCSCKKDS

Signal sequence:

amino acids 1-19 cAMP- and cGMP-dependent protein kinase phosphorylation sites.

amino acids 93-97, 270-274

N-myristoylation sites.

amino acids 19-25, 78-84, 97-103, 100-106, 103-109, 157-163, 191-197, 265-271

Amidation site.

amino acids 26-30

Aspartic acid and asparagine hydroxylation site.

amino acids 152-164

Cell attachment sequence.

amino acids 130-133

EGF-like domain cysteine pattern signature.

amino acids 123-135

FIGURE 3

```
CGCTCGCCCCGTCGCCCCTCGCCTCCCCGCAGAGTCCCCTCGCGGCAGCAGATGTGTGTGGG
GTCAGCCCACGGCGGGGACTATGGTGAAATTCCCGGCGCTCACGCACTACTGGCCCCTGATC
CGGTTCTTGGTGCCCCTGGGCATCACCAACATAGCCATCGACTTCGGGGAGCAGGCCTTGAA
CCGGGGCATTGCTGCTGTCAAGGAGGATGCAGTCGAGATGCTGGCCAGCTACGGCTGGCGT
ACTCCCTCATGAAGTTCTTCACGGGTCCCATGAGTGACTTCAAAAATGTGGGCCTGGTGTTT
GTGAACAGCAAGAGAGACAGGACCAAAGCCGTCCTGTGTATGGTGGTGGCAGGGGCCATCGC
TGCCGTCTTTCACACACTGATAGCTTATAGTGATTTAGGATACTACATTATCAATAAACTGC
ACCATGTGGACGAGTCGGTGGGGAGCAAGACGAGAAGGGCCTTCCTGTACCTCGCCGCCTTT
CCTTTCATGGACGCAATGGCATGGACCCATGCTGGCATTCTCTTAAAACACAAATACAGTTT
CCTGGTGGGATGTGCCTCAATCTCAGATGTCATAGCTCAGGTTGTTTTGTAGCCATTTTGC
TTCACAGTCACCTGGAATGCCGGGAGCCCTGCTCATCCCGATCCTCTCCTTGTACATGGGC
GCACTTGTGCGCTGCACCACCCTGTGCCTGGGCTACTACAAGAACATTCACGACATCATCCC
TGACAGAAGTGGCCCGGAGCTGGGGGGAGATGCAACAATAAGAAAGATGCTGAGCTTCTGGT
GGCCTTTGGCTCTAATTCTGGCCACACAGAGAATCAGTCGGCCTATTGTCAACCTCTTTGTT
TCCCGGGACCTTGGTGGCAGTTCTGCAGCCACAGAGGCAGTGGCGATTTTGACAGCCACATA
CCCTGTGGGTCACATGCCATACGGCTGGTTGACGGAAATCCGTGCTGTGTATCCTGCTTTCG
ACAAGAATAACCCCAGCAACAAACTGGTGAGCACGAGCAACACAGTCACGGCAGCCCACATC
AAGAAGTTCACCTTCGTCTGCATGGCTCTGTCACTACGCTCTGTTTCGTGATGTTTTGGAC
ACCCAACGTGTCTGAGAAAATCTTGATAGACATCATCGGAGTGGACTTTGCCTTTGCAGAAC
TCTGTGTTGTTCCTTTGCGGATCTTCTCCTTCTTCCCAGTTCCAGTCACAGTGAGGGCGCAT
CTCACCGGGTGGCTGATGACACTGAAGAAAACCTTCGTCCTTGCCCCCAGCTCTGTGCTGCG
GATCATCGTCCTCATCGCCAGCCTCGTGGTCCTACCCTACCTGGGGGTGCACGGTGCGACCC
TGGGCGTGGGCTCCCTCCTGGCGGGCTTTGTGGGAGAATCCACCATGGTCGCCATCGCTGCG
TGCTATGTCTACCGGAAGCAGAAAAAGAAGATGGAGAATGAGTCGGCCACGGAGGGGGAAGA
CTCTGCCATGACAGACATGCCTCCGACAGAGGAGGTGACAGACATCGTGGAAATGAGAGAGG
AGAATGAATAAGGCACGGGACGCCATGGGCACTGCAGGGACGGTCAGTCAGGATGACACTTC
GGCATCATCTCTTCCCTCTCCCATCGTATTTTGTTCCCTTTTTTTGTTTTGTTTGGTAAT
GAAAGAGGCCTTGATTTAAAGGTTTCGTGTCAATTCTCTAGCATACTGGGTATGCTCACACT
GACGGGGGGACCTAGTGAATGGTCTTTACTGTTGCTATGTAAAAACAAACGAAACAACTGAC
TTCATACCCCTGCCTCACGAAAACCCAAAAGACACAGCTGCCTCACGGTTGACGTTGTGTCC
TCCTCCCCTGGACAATCTCCTCTTGGAACCAAAGGACTGCAGCTGTGCCATCGCGCCTCGGT
CACCCTGCACAGCAGGCCACAGACTCTCCTGTCCCCCTTCATCGCTCTTAAGAATCAACAGG
TTAAAACTCGGCTTCCTTTGATTTGCTTCCAGTCACATGGCCGTACAAAGAGATGGAGCCC
CGGTGGCCTCTTAAATTTCCCTTCTGCCACGGAGTTCGAAACCATCTACTCCACACATGCAG
GAGGCGGGTGGCACGCTGCAGCCCGGAGTCCCCGTTCACACTGAGGAACGGAGACCTGTGAC
CACAGCAGGCTGACAGATGGACAGAATCTCCCGTAGAAAGGTTTGGTTTGAAATGCCCCGGG
GGCAGCAAACTGACATGGTTAATGATAGCATTTCACTCTGCGTTCTCCTAGATCTGAGCAA
GCTGTCAGTTCTCACCCCCACCGTGTATATACATGAGCTAACTTTTTTAAATTGTCACAAAA
GCGCATCTCCAGATTCCAGACCCTGCCGCATGACTTTTCCTGAAGGCTTGCTTTTCCCTCGC
CTTTCCTGAAGGTCGCATTAGAGCGAGTCACATGGAGCATCCTAACTTTGCATTTTAGTTTT
TACAGTGAACTGAAGCTTTAAGTCTCATCCAGCATTCTAATGCCAGGTTGCTGTAGGGTAAC
TTTTGAAGTAGATATATTACCTGGTTCTGCTATCCTTAGTCATAACTCTGCGGTACAGGTAA
TTGAGAATGTACTACGGTACTTCCCTCCCACACCATACGATAAAGCAAGACATTTTATAACG
ATACCAGAGTCACTATGTGGTCCTCCCTGAAATAACGCATTCGAAATCCATGCAGTGCAGTA
TATTTTTCTAAGTTTTGGAAAGCAGGTTTTTTCCTTTAAAAAAATTATAGACACGGTTCACT
AAATTGATTTAGTCAGAATTCCTAGACTGAAAGAACCTAAACAAAAAATATTTTAAAGATA
TAAATATATGCTGTATATGTTATGTAATTTATTTTAGGCTATAATACATTTCCTATTTTCGC
ATTTTCAATAAAATGTCTCTAATACAAAAAA
```

FIGURE 4

MVKFPALTHYWPLIRFLVPLGITNIAIDFGEQALNRGIAAVKEDAVEMLASYGLAYSLMKFF
TGPMSDFKNVGLVFVNSKRDRTKAVLCMVVAGAIAAVFHTLIAYSDLGYYIINKLHHVDESV
GSKTRRAFLYLAAFPFMDAMAWTHAGILLKHKYSFLVGCASISDVIAQVVFVAILLHSHLEC
REPLLIPILSLYMGALVRCTTLCLGYYKNIHDIIPDRSGPELGGDATIRKMLSFWWPLALIL
ATQRISRPIVNLFVSRDLGGSSAATEAVAILTATYPVGHMPYGWLTEIRAVYPAFDKNNPSN
KLVSTSNTVTAAHIKKFTFVCMALSLTLCFVMFWTPNVSEKILIDIIGVDFAFAELCVVPLR
IFSFFPVPVTVRAHLTGWLMTLKKTFVLAPSSVLRIIVLIASLVVLPYLGVHGATLGVGSLL
AGFVGESTMVAIAACYVYRKQKKKMENESATEGEDSAMTDMPPTEEVTDIVEMREENE

Transmembrane domains:

amino acids 86-106, 163-179, 191-205, 237-253, 327-343, 357-374, 408-423, 431-445

FIGURE 5

CCTGACAGAAGTGCCCCGGAGCTGGGGGAGATNCAACATTAAGAAGATGCTGAGCTTCTGGT
GCCNTTTGGCTCTAATTCTGGCCACACAGAGAANCAGTCGGCCTATTGTCAACCTCTTTGTT
TCCCGGGACCTTGGTGGCAGTTCTGCAGCCACAGAGGCAGTGGCGATTTTGACAGCCACATA
CCCTGTGGGTCACATGCCATACGGCTGGTTGACGGAAATCCGTGCTGTGTATCCTGCTTTCG
ACAAGAATAACCCCAGCAACAAACTGGTGAGCACGAGCAACACAGTCACGGCGGCCCACATC
AAGAAGTTCACCTTCGTCTGCATGGCTCTGTCACTCACGCTCTGTTTCGTGATGTTTTGGAC
ACCCAACGTGTCTGNGAAAATCTTGATAGACATCATCGGAGTGGACTTTGCCTTTGCAGAAC
TCTGTGTTGTTCCTTTGCGGATCTTCTCCTTCTTCCCAGTTCCAGTCACAGTGAGGGCGCAT
CTCACCGGGTGGCTGATGACACTGAAGAAAACCTTCGTC

FIGURE 6

TGACGGAATCCCGGGCTGGGTATCCTGGTTTNGACAAGATAAACCCCCAGCAANAAATTGGG
GAGCAGGGCAAAACAGTNACGGGCAGCCCACATCAAGAAGTTCACCTTNGTTTGNATGGNTC
TGTCAACTCACGCTNTGTTTCGTGATGTTTTGGACACCCAAAGTGTTTGAGAAAATTTTGAT
AGACATNATCGGAGTGGANTTTGCCTTTGCAGAANTTTGNGNTGTTCCTTTGCGGATTTTCT
CCTTTTTCCCAGTTCCAGTCACAGNGAGGGCGCATCTCACCGGGNGGNTGATGACANTGAAG
AAAACCTTTGTCCTTGCCCCCAGCTNTTTGGTGCGGATCATTGTCCTNATNGCCAGCCTTGT
GGTCCTACCCTACCTGGGGGTGCACGGTGCGACCCTGGGCGTGGGTTCCCTCCTGGCGGGCA

FIGURE 7

TATTCCCAGTTCCGGTCACGGGGAGGGCGCATNTCACCGGGTGGCTGANGACACTGAAGAAA
ACCTTNGTCCTTGCCCCCAGNTTTGTGNTGCGGATNATCGTCCTCATCGCCAGCCTNGTGGT
CCTACCCTACCTGGGGGTGCACGGTGAGAC

FIGURE 8

GCCCCGCGCCCGGCGCCGGGCGCCCGAAGCCGGGAGCCACCGCCATGGGGGCCTGCCTGGGA
GCCTGCTCCCTGCTCAGCTGCGCGTCCTGCCTCTGCGGCTCTGCCCCCTGCATCCTGTGCAG
CTGCTGCCCCGCCAGCCGCAACTCCACCGTGAGCCGCCTCATCTTCACGTTCTTCCTCTTCC
TGGGGGTGCTGGTGTCCATCATTATGCTGAGCCCGGGCGTGGAGAGTCAGCTCTACAAGCTG
CCCTGGGTGTGTGAGGAGGGGGCCGGGATCCCCACCGTCCTGCAGGGCCACATCGACTGTGG
CTCCCTGCTTGGCTACCGCGCTGTCTACCGCATGTGCTTCGCCACGGCGGCCTTCTTCTTCT
TCTTTTTCACCCTGCTCATGCTCTGCGTGAGCAGCAGCCGGGACCCCCGGGCTGCCATCCAG
AATGGGTTTTGGTTCTTTAAGTTCCTGATCCTGGTGGGCCTCACCGTGGGTGCCTTCTACAT
CCCTGACGGCTCCTTCACCAACATCTGGTTCTACTTCGGCGTCGTGGGCTCCTTCCTCTTCA
TCCTCATCCAGCTGGTGCTGCTCATCGACTTTGCGCACTCCTGGAACCAGCGGTGGCTGGGC
AAGGCCGAGGAGTGCGATTCCCGTGCCTGGTACGCAGGCCTCTTCTTCTTCACTCTCCTCTT
CTACTTGCTGTCGATCGCGGCCGTGGCGCTGATGTTCATGTACTACACTGAGCCCAGCGGCT
GCCACGAGGGCAAGGTCTTCATCAGCCTCAACCTCACCTTCTGTGTCTGCGTGTCCATCGCT
GCTGTCCTGCCCAAGGTCCAGGACGCCCAGCCCAACTCGGGTCTGCTGCAGGCCTCGGTCAT
CACCCTCTACACCATGTTTGTCACCTGGTCAGCCCTATCCAGTATCCCTGAACAGAAATGCA
ACCCCCATTTGCCAACCCAGCTGGGCAACGAGACAGTTGTGGCAGGCCCCGAGGGCTATGAG
ACCCAGTGGTGGGATGCCCCGAGCATTGTGGGCCTCATCATCTTCCTCCTGTGCACCCTCTT
CATCAGTCTGCGCTCCTCAGACCACCGGCAGGTGAACAGCCTGATGCAGACCGAGGAGTGCC
CACCTATGCTAGACGCCACACAGCAGCAGCAGCAGCAGGTGGCAGCCTGTGAGGGCCGGGCC
TTTGACAACGAGCAGGACGGCGTCACCTACAGCTACTCCTTCTTCCACTTCTGCCTGGTGCT
GGCCTCACTGCACGTCATGATGACGCTCACCAACTGGTACAAGCCCGGTGAGACCCGGAAGA
TGATCAGCACGTGGACCGCCGTGTGGGTGAAGATCTGTGCCAGCTGGGCAGGGCTGCTCCTC
TACCTGTGGACCCTGGTAGCCCCACTCCTCCTGCGCAACCGCGACTTCAGCTGAGGCAGCCT
CACAGCCTGCCATCTGGTGCCTCCTGCCACCTGGTGCCTCTCGGCTCGGTGACAGCCAACCT
GCCCCCTCCCCACACCAATCAGCCAGGCTGAGCCCCCACCCCTGCCCCAGCTCCAGGACCTG
CCCCTGAGCCGGGCCTTCTAGTCGTAGTGCCTTCAGGGTCCGAGGAGCATCAGGCTCCTGCA
GAGCCCCATCCCCCCGCCACACCCACACGGTGGAGCTGCCTCTTCCTTCCCTCCTCCCTGT
TGCCCATACTCAGCATCTCGGATGAAAGGGCTCCCTTGTCCTCAGGCTCCACGGGAGCGGGG
CTGCTGGAGAGAGCGGGGAACTCCCACCACAGTGGGGCATCCGGCACTGAAGCCCTGGTGTT
CCTGGTCACGTCCCCCAGGGGACCCTGCCCCCTTCCTGGACTTCGTGCCTTACTGAGTCTCT
AAGACTTTTTCTAATAAACAAGCCAGTGCGTGTAAAAAAAA

FIGURE 9

MGACLGACSLLSCASCLCGSAPCILCSCCPASRNSTVSRLIFTFFLFLGVLVSIIMLSPGVE
SQLYKLPWVCEEGAGIPTVLQGHIDCGSLLGYRAVYRMCFATAAFFFFFFTLLMLCVSSSRD
PRAAIQNGFWFFKFLILVGLTVGAFYIPDGSFTNIWFYFGVVGSFLFILIQLVLLIDFAHSW
NQRWLGKAEECDSRAWYAGLFFFTLLFYLLSIAAVALMFMYYTEPSGCHEGKVFISLNLTFC
VCVSIAAVLPKVQDAQPNSGLLQASVITLYTMFVTWSALSSIPEQKCNPHLPTQLGNETVVA
GPEGYETQWWDAPSIVGLIIFLLCTLFISLRSSDHRQVNSLMQTEECPPMLDATQQQQQQVA
ACEGRAFDNEQDGVTYSYSFFHFCLVLASLHVMMTLTNWYKPGETRKMISTWTAVWVKICAS
WAGLLLYLWTLVAPLLLRNRDFS

Signal sequence:

amino acids 1-20

Transmembrane domains:

amino acids 40-58, 101-116, 134-150, 162-178, 206-223, 240-257, 272-283, 324-340, 391-406, 428-444

FIGURE 10

```
GAGCGAGGCCGGGGACTGAAGGTGTGGGTGTCGAGCCCTCTGGCAGAGGGTTAACCTGGGTC
AAATGCACGGATTCTCACCTCGTACAGTTACGCTCTCCCGCGGCACGTCCGCGAGGACTTGA
AGTCCTGAGCGCTCAAGTTTGTCCGTAGGTCGAGAGAAGGCCATGGAGGTGCCGCCACCGGC
ACCGCGGAGCTTTCTCTGTAGAGCATTGTGCCTATTTCCCCGAGTCTTTGCTGCCGAAGCTG
TGACTGCCGATTCGGAAGTCCTTGAGGAGCGTCAGAAGCGGCTTCCCTACGTCCCAGAGCCC
TATTACCCGGAATCTGGATGGGACCGCCTCCGGGAGCTGTTTGGCAAAGATGAACAGCAGAG
AATTTCAAAGGACCTTGCTAATATCTGTAAGACGGCAGCTACAGCAGGCATCATTGGCTGGG
TGTATGGGGGAATACCAGCTTTTATTCATGCTAAACAACAATACATTGAGCAGAGCCAGGCA
GAAATTTATCATAACCGGTTTGATGCTGTGCAATCTGCACATCGTGCTGCCACACGAGGCTT
CATTCGTTATGGCTGGCGCTGGGGTTGGAGAACTGCAGTGTTTGTGACTATATTCAACACAG
TGAACACTAGTCTGAATGTATACCGAAATAAAGATGCCTTAAGCCATTTTGTAATTGCAGGA
GCTGTCACGGGAAGTCTTTTTAGGATAAACGTAGGCCTGCGTGGCCTGGTGGCTGGTGGCAT
AATTGGAGCCTTGCTGGGCACTCCTGTAGGAGGCCTGCTGATGGCATTTCAGAAGTACGCTG
GTGAGACTGTTCAGGAAAGAAAACAGAAGGATCGAAAGGCACTCCATGAGCTAAAACTGGAA
GAGTGGAAAGGCAGACTACAAGTTACTGAGCACCTCCCTGAGAAAATTGAAAGTAGTTTACG
GGAAGATGAACCTGAGAATGATGCTAAGAAAATTGAAGCACTGCTAAACCTTCCTAGAAACC
CTTCAGTAATAGATAAACAAGACAAGGACTGAAAGTGCTCTGAACTTGAAACTCACTGGAGA
GCTGAAGGGAGCTGCCATGTCCGATGAATGCCAACAGACAGGCCACTCTTTGGTCAGCCTGC
TGACAAATTTAAGTGCTGGTACCTGTGGTGGCAGTGGCTTGCTCTTGTCTTTTTCTTTTCTT
TTTAACTAAGAATGGGGCTGTTGTACTCTCACTTTACTTATCCTTAAATTTAAATACATACT
TATGTTTGTATTAATCTATCAATATATGCATACATGGATATATCCACCCACCTAGATTTTAA
GCAGTAAATAAAACATTTCGCAAAAGATTAAAGTTGAATTTTACAGTTT
```

FIGURE 11

```
></usr/seqdb2/sst/DNA/Dnaseqs.min/ss.DNA23318
><subunit 1 of 1, 285 aa, 1 stop
><MW: 32190, pI: 9.03, NX(S/T): 2
MEVPPPAPRSFLCRALCLFPRVFAAEAVTADSEVLEERQKRLPYVPEPYYPESGWDRLRELF
GKDEQQRISKDLANICKTAATAGIIGWVYGGIPAFIHAKQQYIEQSQAEIYHNRFDAVQSAH
RAATRGFIRYGWRWGWRTAVFVTIFNTVNTSLNVYRNKDALSHFVIAGAVTGSLFRINVGLR
GLVAGGIIGALLGTPVGGLLMAFQKYAGETVQERKQKDRKALHELKLEEWKGRLQVTEHLPE
KIESSLREDEPENDAKKIEALLNLPRNPSVIDKQDKD
```

Important Features:

Signal Peptide:

amino acids 1-24

Transmembrane domains:

amino acids 76-96 and 171-195

N-glycosylation site:

amino acids 153-156

FIGURE 12

CGGAAGTCCCTTGAGGAGCGTCAGAAGCGGCTTCCCTACGTCCCAGAGCCCTATTACCCGGA
ATCTGGATGGGACCGCTCCGGGAGCTGTTTGGCAAAGATGAACAGCAGAGAATTTCAAAGGA
CCTTGCTAATATCTGTAAGACGGCAGCTACAGCAGGCATCATTGGCTGGGTGTATGGGGGAA
TACCAGCTTTTATTCATGCTAAACAACAATACATTGAGCAGAGCCAGGCAGAAATTTATCAT
AACCGGTTTGATGCTGTGCAATCTGCACATCGTGCTGCCACACGAGGCTTCATTCGTTCATG
GCTGGCGCCGAACC

FIGURE 13

TCAAGTTTGTCCGTAGGTCGAGAGAAGGCCATGGAGGTGCCGCCACCGGCACCGCGGAGCTT
TTTTCTGTAGAGCATTGTGCCTATTTCCCCGAGTTTTTGCTGCCGAAGCTGTGACTGCCGAT
TCGGAAGTCCTTGAGGAGCGTCAGAAGCGGCTTCCCTACGTCCCAGAGCCCTATTACCCGGA
ATTTGGATGGGACCGCCTCCGGGAGCTGTTTGGCAAAGATGAACAGCAGAGAATTTCAAAGG
ACCTTGCTGATATNTGTAAGACGGCAGCTACAGCAGGCATCATTGGCTGGGTGTATGGGGA
ATACCAGCTTTTATTCATGNTAAACAACAATACATTGAGCAGAGCCAGGCAGAAATTTATNA
TAACC

FIGURE 14

```
GAGCCGCCGCCGCGCGCGCCGCGCACTGCAGCCCCAGGCCCCGGCCCCCCACCCACGTCT
GCGTTGCTGCCCCGCCTGGGCCAGGCCCCAAAGGCAAGGACAAAGCAGCTGTCAGGGAACCT
CCGCCGGAGTCGAATTTACGTGCAGCTGCCGGCAACCACAGGTTCCAAGATGGTTTGCGGGG
GCTTCGCGTGTTCCAAGAACTGCCTGTGCGCCCTCAACCTGCTTTACACCTTGGTTAGTCTG
CTGCTAATTGGAATTGCTGCGTGGGCATTGGCTTCGGGCTGATTTCCAGTCTCCGAGTGGT
CGGCGTGGTCATTGCAGTGGGCATCTTCTTGTTCCTGATTGCTTTAGTGGGTCTGATTGGAG
CTGTAAAACATCATCAGGTGTTGCTATTTTTTATATGATTATTCTGTTACTTGTATTTATT
GTTCAGTTTTCTGTATCTTGCGCTTGTTTAGCCCTGAACCAGGAGCAACAGGGTCAGCTTCT
GGAGGTTGGTTGGAACAATACGGCAAGTGCTCGAAATGACATCCAGAGAAATCTAAACTGCT
GTGGGTTCCGAAGTGTTAACCCAAATGACACCTGTCTGGCTAGCTGTGTTAAAAGTGACCAC
TCGTGCTCGCCATGTGCTCCAATCATAGGAGAATATGCTGGAGAGGTTTTGAGATTTGTTGG
TGGCATTGGCCTGTTCTTCAGTTTTACAGAGATCCTGGGTGTTTGGCTGACCTACAGATACA
GGAACCAGAAAGACCCCGCGCGAATCCTAGTGCATTCCTTTGATGAGAAAACAAGGAAGAT
TTCCTTTCGTATTATGATCTTGTTCACTTTCTGTAATTTTCTGTTAAGCTCCATTTGCCAGT
TTAAGGAAGGAAACACTATCTGGAAAAGTACCTTATTGATAGTGGAATTATATATTTTTACT
CTATGTTTCTCTACATGTTTTTTTCTTTCCGTTGCTGAAAAATATTTGAAACTTGTGGTCTC
TGAAGCTCGGTGGCACCTGGAATTTACTGTATTCATTGTCGGGCACTGTCCACTGTGGCCTT
TCTTAGCATTTTTACCTGCAGAAAAACTTTGTATGGTACCACTGTGTTGGTTATATGGTGAA
TCTGAACGTACATCTCACTGGTATAATTATATGTAGCACTGTGCTGTGTAGATAGTTCCTAC
TGGAAAAAGAGTGGAAATTTATTAAAATCAGAAAGTATGAGATCCTGTTATGTTAAGGGAAA
TCCAAATTCCCAATTTTTTTTGGTCTTTTTAGGAAAGATTGTTGTGGTAAAAAGTGTTAGTA
TAAAAATGATAATTTACTTGTAGTCTTTTATGATTACACCAATGTATTCTAGAAATAGTTAT
GTCTTAGGAAATTGTGGTTTAATTTTTGACTTTTACAGGTAAGTGCAAAGGAGAAGTGGTTT
CATGAAATGTTCTAATGTATAATAACATTTACCTTCAGCCTCCATCAGAATGGAACGAGTTT
TGAGTAATCAGGAAGTATATCTATATGATCTTGATATTGTTTTATAATAATTTGAAGTCTAA
AAGACTGCATTTTTAAACAAGTTAGTATTAATGCGTTGGCCCACGTAGCAAAAAGATATTTG
ATTATCTTAAAAATTGTTAAATACCGTTTTCATGAAATTTCTCAGTATTGTAACAGCAACTT
GTCAAACCTAAGCATATTTGAATATGATCTCCCATAATTTGAAATTGAAATCGTATTGTGTG
GCTCTGTATATTCTGTTAAAAAATTAAAGGACAGAAACCTTTCTTTGTGTATGCATGTTTGA
ATTAAAAGAAAGTAATGGAAG
```

FIGURE 15

></usr/seqdb2/sst/DNA/Dnaseqs.min/ss.DNA39979
><subunit 1 of 1, 204 aa, 1 stop
><MW: 22147, pI: 8.37, NX(S/T): 3
MVCGGFACSKNCLCALNLLYTLVSLLLIGIAAWGIGFGLISSLRVVGVVIAVGIFLFLIALV
GLIGAVKHHQVLLFFYMIILLLVFIVQFSVSCACLALNQEQQGQLLEVGWNNTASARNDIQR
NLNCCGFRSVNPNDTCLASCVKSDHSCSPCAPIIGEYAGEVLRFVGGIGLFFSFTEILGVWL
TYRYRNQKDPRANPSAFL

Signal Peptide:
amino acids 1-34

Transmembrane domains:
amino acids 47-63, 72-95 and 162-182

FIGURE 16

TGATTGGAGCTGTAAAAAANTCTTCAGGTGTTGTNATTTTTTTATATGATTATTCTGTAANT
TGTATTTATTGTTCAGTTTTNTGTATCTTGCGCTTGTTTAGCCNTGAACCAGGAGCAACAGG
GTCAGNTTNTGGAGGTTGGTTGGAACAATACGGCAAGTGCTCGAAATGACATCCAGAGAAAT
NTAAACTGCTGTGGGTTCCGAAGTGTTAACCCAAATGACACCTGTNTGGCTAGCTGTGTTAA
AAGTGACCACTNGTGCTCGCCATGTGCTCCAATCATAGGAGAATATGCTGGAGAGGTTTTGA
GATTTGTTGGTGGCATTGGCCTGTTNTTCAGTTTTACAGAGATCCTGGGTGTTTGGCTGACC
TACAGATACAGGAACCAG

FIGURE 17

AATCCCAAATTCCCCAATTTTTTTGGNCTTTTTAGGGAAAGATGTGTTGTGGTAAAAAGTGT
TAGTATAAAAATGATAATTTACTTGTAGTCTTTTATGATTACACCAATGTATTCTAGAATAG
TTATGTCTTAGGAAATTGTGGTTTAATTTTTGACTTTTACAGGTAAGTGCAAAGGAGAAGTG
GTTTCATGAAATGTTCTAATGTATAATAACATTTACCTTCAGCCTCCCATCAGAATGGAACG
AGTTTTGAGTAATCCAGGAAGTATATCTATATGATCTTGATATTGTTTTATATAATTTGAAG
TCTAAAAGACTGCATTTTTAAACAAGTTAGTATTAATGCGTTGGCCCACGTAGCAAAAAGAT
ATTTGATTATCTTAAAAATTGTTAAATACCGTTTTCATGAAAGTTCTCAGTATTGTAACAGC
AACTTGTCAAACCTAAGCATATTTGAATATGATCTCCCATAATTTGAAATTGAAATCGTATT
GTGTGGAGGAAATGGCAATCTTATGTGTGCTGAAGGACACAGTAAGAGCACCAAGTTGTGCC
CCACTTGC

FIGURE 18

ATGATTATTCTGTTACTTGTATTTATTGTTCAGTTTTATGGTATCTTGCGCTTGTTTAGCCC
CTGAAACCAGGAGCAACAGGGNNCAGCTTCCTGGAGGTTGGTTGGCAACAATCACGGCCAAG
TGACTCCGCAAATGACATCCCAGAGAAATCCTAAACTGCTGTGGGTTCCGAAGTGTTAACCC
AAATGACACCTGTCTGGCTNGCTGTGTTAAAAGTGACCACTCGTGCTCGCCATGTGCTCCAA
TCATAGGAGAATATGC

FIGURE 19

```
CAGTCACCATGAAGCTGGGCTGTGTCCTCATGGCCTGGGCCCTCTACCTTTCCCTTGGTGTG
CTCTGGGTGGCCCAGATGCTACTGGCTGCCAGTTTTGAGACGCTGCAGTGTGAGGGACCTGT
CTGCACTGAGGAGAGCAGCTGCCACACGGAGGATGACTTGACTGATGCAAGGGAAGCTGGCT
TCCAGGTCAAGGCCTACACTTTCAGTGAACCCTTCCACCTGATTGTGTCCTATGACTGGCTG
ATCCTCCAAGGTCCAGCCAAGCCAGTTTTTGAAGGGGACCTGCTGGTTCTGCGCTGCCAGGC
CTGGCAAGACTGGCCACTGACTCAGGTGACCTTCTACCGAGATGGCTCAGCTCTGGGTCCCC
CCGGGCCTAACAGGGAATTCTCCATCACCGTGGTACAAAAGGCAGACAGCGGGCACTACCAC
TGCAGTGGCATCTTCCAGAGCCCTGGTCCTGGGATCCAGAAACAGCATCTGTTGTGGCTAT
CACAGTCCAAGAACTGTTTCCAGCGCCAATTCTCAGAGCTGTACCCTCAGCTGAACCCCAAG
CAGGAAGCCCCATGACCCTGAGTTGTCAGACAAAGTTGCCCCTGCAGAGGTCAGCTGCCCGC
CTCCTCTTCTCCTTCTACAAGGATGGAAGGATAGTGCAAAGCAGGGGCTCTCCTCAGAATT
CCAGATCCCCACAGCTTCAGAAGATCACTCCGGGTCATACTGGTGTGAGGCAGCCACTGAGG
ACAACCAAGTTTGGAAACAGAGCCCCAGCTAGAGATCAGAGTGCAGGGTGCTTCCAGCTCT
GCTGCACCTCCCACATTGAATCCAGCTCCTCAGAAATCAGCTGCTCCAGGAACTGCTCCTGA
GGAGGCCCCTGGGCCTCTGCCTCCGCCGCCAACCCCATCTTCTGAGGATCCAGGCTTTTCTT
CTCCTCTGGGGATGCCAGATCCTCATCTGTATCACCAGATGGGCCTTCTTCTCAAACACATG
CAGGATGTGAGAGTCCTCCTCGGTCACCTGCTCATGGAGTTGAGGGAATTATCTGGCCACCA
GAAGCCTGGGACCACAAAGGCTACTGCTGAATAGAAGTAAACAGTTCATCCATGATCTCACT
TAACCACCCCAATAAATCTGATTCTTTATTTTCTCTTCCTGTCCTGCACATATGCATAAGTA
CTTTTACAAGTTGTCCCAGTGTTTTGTTAGAATAATGTAGTTAGGTGAGTGTAAATAAATTT
ATATAAAGTGAGAATTAGAGTTTAGCTATAATTGTGTATTCTCTCTTAACACAACAGAATTC
TGCTGTCTAGATCAGGAATTTCTATCTGTTATATCGACCAGAATGTTGTGATTTAAAGAGAA
CTAATGGAAGTGGATTGAATACAGCAGTCTCAACTGGGGGCAATTTTGCCCCCCAGAGGACA
TTGGGCAATGTTTGGAGACATTTTGGTCATTATACTTGGGGGGTTGGGGGATGGTGGGATGT
GTGTCTACTGGCATCCAGTAAATAGAAGCCAGGGGTGCCGCTAAACATCCTATAATGCACAG
GGCAGTACCCCACAACGAAAATAATCTGGCCCAAAATGTCAGTTGTACTGAGTTTGAGAAA
CCCCAGCCTAATGAAACCCTAGGTGTTGGGCTCTGGAATGGGACTTTGTCCCTTCTAATTAT
TATCTCTTTCCAGCCTCATTCAGCTATTCTTACTGACATACCAGTCTTTAGCTGGTGCTATG
GTCTGTTCTTTAGTTCTAGTTTGTATCCCCTCAAAAGCCATTATGTTGAAATCCTAATCCCC
AAGGTGATGGCATTAAGAAGTGGGCCTTTGGGAAGTGATTAGATCAGGAGTGCAGAGCCCTC
ATGATTAGGATTAGTGCCCTTATTTAAAAAGGCCCCAGAGAGCTAACTCACCCTTCCACCAT
ATGAGGACGTGGCAAGAAGATGACATGTATGAGAACCAAAAAACAGCTGTCGCCAAACACCG
ACTCTGTCGTTGCCTTGATCTTGAACTTCCAGCCTCCAGAACTATGAGAAATAAAATTCTGG
TTGTTTGTAGCCTAA
```

FIGURE 20

></usr/seqdb2/sst/DNA/Dnaseqs.min/ss.DNA40594
><subunit 1 of 1, 359 aa, 1 stop
><MW: 38899, pI: 5.21, NX(S/T): 0
MKLGCVLMAWALYLSLGVLWVAQMLLAASFETLQCEGPVCTEESSCHTEDDLTDAREAGFQV
KAYTFSEPFHLIVSYDWLILQGPAKPVFEGDLLVLRCQAWQDWPLTQVTFYRDGSALGPPGP
NREFSITVVQKADSGHYHCSGIFQSPGPGIPETASVVAITVQELFPAPILRAVPSAEPQAGS
PMTLSCQTKLPLQRSAARLLFSFYKDGRIVQSRGLSSEFQIPTASEDHSGSYWCEAATEDNQ
VWKQSPQLEIRVQGASSSAAPPTLNPAPQKSAAPGTAPEEAPGPLPPPPTPSSEDPGFSSPL
GMPDPHLYHQMGLLLKHMQDVRVLLGHLLMELRELSGHQKPGTTKATAE

Signal sequence:
amino acids 1-17

Leucine zipper pattern sequence:
amino acids 12-33

Protein kinase C phosphorylation site:
amino acids 353-355

FIGURE 21

```
CCCACGCGTCCGCCCACGCGTCCGCCCACGGGTCCGCCCACGCGTCCGGGCCACCAGAAGTT
TGAGCCTCTTTGGTAGCAGGAGGCTGGAAGAAAGGACAGAAGTAGCTCTGGCTGTGATGGGG
ATCTTACTGGGCCTGCTACTCCTGGGGCACCTAACAGTGGACACTTATGGCCGTCCCATCCT
GGAAGTGCCAGAGAGTGTAACAGGACCTTGGAAAGGGGATGTGAATCTTCCCTGCACCTATG
ACCCCCTGCAAGGCTACACCCAAGTCTTGGTGAAGTGGCTGGTACAACGTGGCTCAGACCCT
GTCACCATCTTTCTACGTGACTCTTCTGGAGACCATATCCAGCAGGCAAAGTACCAGGGCCG
CCTGCATGTGAGCCACAAGGTTCCAGGAGATGTATCCCTCCAATTGAGCACCCTGGAGATGG
ATGACCGGAGCCACTACACGTGTGAAGTCACCTGGCAGACTCCTGATGGCAACCAAGTCGTG
AGAGATAAGATTACTGAGCTCCGTGTCCAGAAACTCTCTGTCTCCAAGCCCACAGTGACAAC
TGGCAGCGGTTATGGCTTCACGGTGCCCAGGGAATGAGGATTAGCCTTCAATGCCAGGCTC
GGGGTTCTCCTCCCATCAGTTATATTTGGTATAAGCAACAGACTAATAACCAGGAACCCATC
AAAGTAGCAACCCTAAGTACCTTACTCTTCAAGCCTGCGGTGATAGCCGACTCAGGCTCCTA
TTTCTGCACTGCCAAGGGCCAGGTTGGCTCTGAGCAGCACAGCGACATTGTGAAGTTTGTGG
TCAAAGACTCCTCAAAGCTACTCAAGACCAAGACTGAGGCACCTACAACCATGACATACCCC
TTGAAAGCAACATCTACAGTGAAGCAGTCCTGGGACTGGACCACTGACATGGATGGCTACCT
TGGAGAGACCAGTGCTGGGCCAGGAAAGAGCCTGCCTGTCTTTGCCATCATCCTCATCATCT
CCTTGTGCTGTATGGTGGTTTTTACCATGGCCTATATCATGCTCTGTCGGAAGACATCCCAA
CAAGAGCATGTCTACGAAGCAGCCAGGTAAGAAAGTCTCTCCTCTTCCATTTTTGACCCCGT
CCCTGCCCTCAATTTTGATTACTGGCAGGAAATGTGGAGGAAGGGGGGTGTGGCACAGACCC
AATCCTAAGGCCGGAGGCCTTCAGGGTCAGGACATAGCTGCCTTCCCTCTCTCAGGCACCTT
CTGAGGTTGTTTTGGCCCTCTGAACACAAAGGATAATTTAGATCCATCTGCCTTCTGCTTCC
AGAATCCCTGGGTGGTAGGATCCTGATAATTAATTGGCAAGAATTGAGGCAGAAGGGTGGGA
AACCAGGACCACAGCCCCAAGTCCCTTCTTATGGGTGGTGGGCTCTTGGGCCATAGGGCACA
TGCCAGAGAGGCCAACGACTCTGGAGAAACCATGAGGGTGGCCATCTTCGCAAGTGGCTGCT
CCAGTGATGAGCCAACTTCCCAGAATCTGGGCAACAACTACTCTGATGAGCCCTGCATAGGA
CAGGAGTACCAGATCATCGCCCAGATCAATGGCAACTACGCCCGCCTGCTGGACACAGTTCC
TCTGGATTATGAGTTTCTGGCCACTGAGGGCAAAAGTGTCTGTTAAAAATGCCCCATTAGGC
CAGGATCTGCTGACATAATTGCCTAGTCAGTCCTTGCCTTCTGCATGGCCTTCTTCCCTGCT
ACCTCTCTTCCTGGATAGCCCAAAGTGTCCGCCTACCAACACTGGAGCCGCTGGGAGTCACT
GGCTTTGCCCTGGAATTTGCCAGATGCATCTCAAGTAAGCCAGCTGCTGGATTTGGCTCTGG
GCCCTTCTAGTATCTCTGCCGGGGCTTCTGGTACTCCTCTCTAAATACCAGAGGGAAGATG
CCCATAGCACTAGGACTTGGTCATCATGCCTACAGACACTATTCAACTTTGGCATCTTGCCA
CCAGAAGACCCGAGGGAGGCTCAGCTCTGCCAGCTCAGAGGACCAGCTATATCCAGGATCAT
TTCTCTTTCTTCAGGGCCAGACAGCTTTTAATTGAAATTGTTATTTCACAGGCCAGGGTTCA
GTTCTGCTCCTCCACTATAAGTCTAATGTTCTGACTCTCTCCTGGTGCTCAATAAATATCTA
ATCATAACAGC
```

FIGURE 22

```
></usr/seqdb2/sst/DNA/Dnaseqs.min/ss.DNA45416
><subunit 1 of 1, 321 aa, 1 stop
><MW: 35544, pI: 8.51, NX(S/T): 0
MGILLGLLLLGHLTVDTYGRPILEVPESVTGPWKGDVNLPCTYDPLQGYTQVLVKWLVQRGS
DPVTIFLRDSSGDHIQQAKYQGRLHVSHKVPGDVSLQLSTLEMDDRSHYTCEVTWQTPDGNQ
VVRDKITELRVQKLSVSKPTVTTGSGYGFTVPQGMRISLQCQARGSPPISYIWYKQQTNNQE
PIKVATLSTLLFKPAVIADSGSYFCTAKGQVGSEQHSDIVKFVVKDSSKLLKTKTEAPTTMT
YPLKATSTVKQSWDWTTDMDGYLGETSAGPGKSLPVFAIILIISLCCMVVFTMAYIMLCRKT
SQQEHVYEAAR
```

Signal Sequence:
amino acids 1-19

Glycosaminoglycan attachment site:
amino acids 149-152

Transmembrane domain:
amino acids 282-300

FIGURE 23

```
GCGCCGGGAGCCCATCTGCCCCCAGGGGCACGGGGCGCGGGGCCGGCTCCCGCCCGGCACAT
GGCTGCAGCCACCTCGCGCGCACCCCGAGGCGCCGCGCCCAGCTCGCCCGAGGTCCGTCGGA
GGCGCCCGGCCGCCCCGGAGCCAAGCAGCAACTGAGCGGGGAAGCGCCCGCGTCCGGGGATC
GGGATGTCCCTCCTCCTTCTCCTCTTGCTAGTTTCCTACTATGTTGGAACCTTGGGGACTCA
CACTGAGATCAAGAGAGTGGCAGAGGAAAAGGTCACTTTGCCCTGCCACCATCAACTGGGGC
TTCCAGAAAAAGACACTCTGGATATTGAATGGCTGCTCACCGATAATGAAGGGAACCAAAAA
GTGGTGATCACTTACTCCAGTCGTCATGTCTACAATAACTTGACTGAGGAACAGAAGGGCCG
AGTGGCCTTTGCTTCCAATTTCCTGGCAGGAGATGCCTCCTTGCAGATTGAACCTCTGAAGC
CCAGTGATGAGGGCCGGTACACCTGTAAGGTTAAGAATTCAGGGCGCTACGTGTGGAGCCAT
GTCATCTTAAAAGTCTTAGTGAGACCATCCAAGCCCAAGTGTGAGTTGGAAGGAGAGCTGAC
AGAAGGAAGTGACCTGACTTTGCAGTGTGAGTCATCCTCTGGCACAGAGCCCATTGTGTATT
ACTGGCAGCGAATCCGAGAGAAAGAGGGAGAGGATGAACGTCTGCCTCCCAAATCTAGGATT
GACTACAACCACCCTGGACGAGTTCTGCTGCAGAATCTTACCATGTCCTACTCTGGACTGTA
CCAGTGCACAGCAGGCAACGAAGCTGGAAGGAAAGCTGTGTGGTGCGAGTAACTGTACAGT
ATGTACAAAGCATCGGCATGGTTGCAGGAGCAGTGACAGGCATAGTGGCTGGAGCCCTGCTG
ATTTTCCTCTTGGTGTGGCTGCTAATCCGAAGGAAAGACAAAGAAAGATATGAGGAAGAAGA
GAGACCTAATGAAATTCGAGAAGATGCTGAAGCTCCAAAAGCCCGTCTTGTGAAACCCAGCT
CCTCTTCCTCAGGCTCTCGGAGCTCACGCTCTGGTTCTTCCTCCACTCGCTCCACAGCAAAT
AGTGCCTCACGCAGCCAGCGGACACTGTCAACTGACGCAGCACCCCAGCCAGGGCTGGCCAC
CCAGGCATACAGCCTAGTGGGGCCAGAGGTGAGAGGTTCTGAACCAAAGAAAGTCCACCATG
CTAATCTGACCAAAGCAGAAACCACACCCAGCATGATCCCCAGCCAGAGCAGAGCCTTCCAA
ACGGTCTGAATTACAATGGACTTGACTCCCACGCTTTCCTAGGAGTCAGGGTCTTTGGACTC
TTCTCGTCATTGGAGCTCAAGTCACCAGCCACACAACCAGATGAGAGGTCATCTAAGTAGCA
GTGAGCATTGCACGGAACAGATTCAGATGAGCATTTTCCTTATACAATACCAAACAAGCAAA
AGGATGTAAGCTGATTCATCTGTAAAAAGGCATCTTATTGTGCCTTTAGACCAGAGTAAGGG
AAAGCAGGAGTCCAAATCTATTTGTTGACCAGGACCTGTGGTGAGAAGGTTGGGGAAAGGTG
AGGTGAATATACCTAAAACTTTTAATGTGGGATATTTTGTATCAGTGCTTTGATTCACAATT
TTCAAGAGGAAATGGGATGCTGTTTGTAAATTTTCTATGCATTTCTGCAAACTTATTGGATT
ATTAGTTATTCAGACAGTCAAGCAGAACCCACAGCCTTATTACACCTGTCTACACCATGTAC
TGAGCTAACCACTTCTAAGAAACTCCAAAAAGGAAACATGTGTCTTCTATTCTGACTTAAC
TTCATTTGTCATAAGGTTTGGATATTAATTTCAAGGGGAGTTGAAATAGTGGGAGATGGAGA
AGAGTGAATGAGTTTCTCCCACTCTATACTAATCTCACTATTTGTATTGAGCCCAAAATAAC
TATGAAAGGAGACAAAAATTTGTGACAAAGGATTGTGAAGAGCTTTCCATCTTCATGATGTT
ATGAGGATTGTTGACAAACATTAGAAATATATAATGGAGCAATTGTGGATTTCCCCTCAAAT
CAGATGCCTCTAAGGACTTTCCTGCTAGATATTTCTGGAAGGAGAAAATACAACATGTCATT
TATCAACGTCCTTAGAAAGAATTCTTCTAGAGAAAAAGGGATCTAGGAATGCTGAAAGATTA
CCCAACATACCATTATAGTCTCTTCTTTCTGAGAAAATGTGAAACCAGAATTGCAAGACTGG
GTGGACTAGAAAGGGAGATTAGATCAGTTTTCTCTTAATATGTCAAGGAAGGTAGCCGGGCA
TGGTGCCAGGCACCTGTAGGAAAATCCAGCAGGTGGAGGTTGCAGTGAGCCGAGATTATGCC
ATTGCACTCCAGCCTGGGTGACAGAGCGGGACTCCGTCTC
```

FIGURE 24

```
></usr/seqdb2/sst/DNA/Dnaseqs.min/ss.DNA45419
><subunit 1 of 1, 373 aa, 1 stop
><MW: 41281, pI: 8.33, NX(S/T): 3
MSLLLLLLLLVSYYVGTLGTHTEIKRVAEEKVTLPCHHQLGLPEKDTLDIEWLLTDNEGNQKV
VITYSSRHVYNNLTEEQKGRVAFASNFLAGDASLQIEPLKPSDEGRYTCKVKNSGRYVWSHV
ILKVLVRPSKPKCELEGELTEGSDLTLQCESSSGTEPIVYYWQRIREKEGEDERLPPKSRID
YNHPGRVLLQNLTMSYSGLYQCTAGNEAGKESCVVRVTVQYVQSIGMVAGAVTGIVAGALLI
FLLVWLLIRRKDKERYEEEERPNEIREDAEAPKARLVKPSSSSSGSRSSRSGSSSTRSTANS
ASRSQRTLSTDAAPQPGLATQAYSLVGPEVRGSEPKKVHHANLTKAETTPSMIPSQSRAFQTV
```

Signal sequence:

amino acids 1-16

Transmembrane domain:

amino acids 232-251

FIGURE 25

```
GTCGTTCCTTTGCTCTCTCGCGCCCAGTCCTCCTCCCTGGTTCTCCTCAGCCGCTGTCGGAGGAGAGCACCCGGA
GACGCGGGCTGCAGTCGCGGCGGCTTCTCCCCGCCTGGGCGGCCTCGCCGCTGGGCAGGTGCTGAGCGCCCCTAG
AGCCTCCCTTGCCGCCTCCCTCCTCTGCCCGGCCGCAGCAGTGCACATGGGGTGTTGGAGGTAGATGGGCTCCCG
GCCCGGGAGGCGGCGGTGGATGCGGCGCTGGGCAGAAGCAGCCGCCGATTCCAGCTGCCCCGCGCGCCCCGGGCG
CCCCTGCGAGTCCCCGGTTCAGCCATGGGGACCTCTCCGAGCAGCAGCACCGCCCTCGCCTCCTGCAGCCGCATC
GCCCGCCGAGCCACAGCCACGATGATCGCGGGCTCCCTTCTCCTGCTTGGATTCCTTAGCACCACCACAGCTCAG
CCAGAACAGAAGGCCTCGAATCTCATTGGCACATACCGCCATGTTGACCGTGCCACCGGCCAGGTGCTAACCTGT
GACAAGTGTCCAGCAGGAACCTATGTCTCTGAGCATTGTACCAACACAAGCCTGCGCGTCTGCAGCAGTTGCCCT
GTGGGGACCTTTACCAGGCATGAGAATGGCATAGAGAAATGCCATGACTGTAGTCAGCCATGCCCATGGCCAATG
ATTGAGAAATTACCTTGTGCTGCCTTGACTGACCGAGAATGCACTTGCCCACCTGGCATGTTCCAGTCTAACGCT
ACCTGTGCCCCCATACGGTGTGTCCTGTGGGTTGGGTGTGCGGAAGAAAGGGACAGAGACTGAGGATGTGCGG
TGTAAGCAGTGTGCTCGGGGTACCTTCTCAGATGTGCCTTCTAGTGTGATGAAATGCAAAGCATACACAGACTGT
CTGAGTCAGAACCTGGTGGTGATCAAGCCGGGGACCAAGGAGACAGACAACGTCTGTGGCACACTCCCGTCCTTC
TCCAGCTCCACCTCACCTTCCCCTGGCACAGCCATCTTTCCACGCCCTGAGCACATGGAAACCCATGAAGTCCCT
TCCTCCACTTATGTTCCCAAAGGCATGAACTCAACAGAATCCAACTCTTCTGCCTCTGTTAGACCAAAGGTACTG
AGTAGCATCCAGGAAGGGACAGTCCCTGACAACACAAGCTCAGCAAGGGGGAAGGAAGACGTGAACAAGACCCTC
CCAAACCTTCAGGTAGTCAACCACCAGCAAGGCCCCCACCACAGACACATCCTGAAGCTGCTGCCGTCCATGGAG
GCCACTGGGGCGAGAAGTCCAGCACGCCCATCAAGGGCCCCAAGAGGGGACATCCTAGACAGAACCTACACAAG
CATTTTGACATCAATGAGCATTTGCCCTGGATGATTGTGCTTTTCCTGCTGCTGGTGCTTGTGGTGATTGTGGTG
TGCAGTATCCGGAAAAGCTCGAGGACTCTGAAAAAGGGGCCCCGGCAGGATCCCAGTGCCATTGTGGAAAAGGCA
GGGCTGAAGAAATCCATGACTCCAACCCAGAACCGGGAGAAATGGATCTACTACTGCAATGGCCATGGTATCGAT
ATCCTGAAGCTTGTAGCAGCCCAAGTGGGAAGCCAGTGGAAAGATATCTATCAGTTTCTTTGCAATGCCAGTGAG
AGGGAGGTTGCTGCTTTCTCCAATGGGTACACAGCCGACCACGAGCGGGCCTACGCAGCTCTGCAGCACTGGACC
ATCCGGGCCCCGAGGCCAGCCTCGCCCAGCTAATTAGCGCCCTGCGCCAGCACCGGAGAAACGATGTTGTGGAG
AAGATTCGTGGGCTGATGGAAGACACCACCCAGCTGGAAACTGACAAACTAGCTCTCCCGATGAGCCCCAGCCCG
CTTAGCCCGAGCCCCATCCCCAGCCCCAACGCGAAACTTGAGAATTCCGCTCTCCTGACGGTGGAGCCTTCCCCA
CAGGACAAGAACAAGGGCTTCTTCGTGGATGAGTCGGAGCCCCTTCTCCGCTGTGACTCTACATCCAGCGGCTCC
TCCGCGCTGAGCAGGAACGGTTCCTTTATTACCAAAGAAAAGAAGGACACAGTGTTGCGGCAGGTACGCCTGGAC
CCCTGTGACTTGCAGCCTATCTTTGATGACATGCTCCACTTTCTAAATCCTGAGGAGCTGCGGGTGATTGAAGAG
ATTCCCCAGGCTGAGGACAAACTAGACCGGCTATTCGAAATTATTGGAGTCAAGAGCCAGGAAGCCAGCCAGACC
CTCCTGGACTCTGTTTATAGCCATCTTCCTGACCTGCTGTAGAACATAGGGATACTGCATTCTGGAAATTACTCA
ATTTAGTGGCAGGGTGGTTTTTTAATTTTCTTCTGTTTCTGATTTTTGTTGTTTGGGGTGTGTGTGTGTGTTTGT
GTGTGTGTGTGTGTGTGTGTGTGTGTGTGTTTAACAGAGAATATGGCCAGTGCTTGAGTTCTTTCTCCTTCTC
TCTCTCTCTTTTTTTTTAAATAACTCTTCTGGGAAGTTGGTTTATAAGCCTTTGCCAGGTGTAACTGTTGTGAA
ATACCCACCACTAAAGTTTTTTAAGTTCCATATTTTCTCCATTTTGCCTTCTTATGTATTTTCAAGATTATTCTG
TGCACTTTAAATTTACTTAACTTACCATAAATGCAGTGTGACTTTTCCCACACACTGGATTGTGAGGCTCTTAAC
TTCTTAAAAGTATAATGGCATCTTGTGAATCCTATAAGCAGTCTTTATGTCTCTTAACATTCACACCTACTTTTT
AAAAACAAATATTATTACTATTTTTATTATTGTTTGTCCTTTATAAATTTTCTTAAAGATTAAGAAAATTTAAGA
CCCCATTGAGTTACTGTAATGCAATTCAACTTTGAGTTATCTTTTAAATATGTCTTGTATAGTTCATATTCATGG
CTGAAACTTGACCACACTATTGCTGATTGTATGGTTTTCACCTGGACACCGTGTAGAATGCTTGATTACTTGTAC
TCTTCTTATGCTAATATGCTCTGGGCTGGAGAAATGAAATCCTCAAGCCATCAGGATTTGCTATTTAAGTGGCTT
GACAACTGGGCCACCAAAGAACTTGAACTTCACCTTTTAGGATTTGAGCTGTTCTGGAACACATTGCTGCACTTT
GGAAAGTCAAAATCAAGTGCCAGTGGCGCCCTTTCCATAGAGAATTTGCCCAGCTTTGCTTTAAAAGATGTCTTG
TTTTTTATATACACATAATCAATAGGTCCAATCTGCTCTCAAGGCCTTGGTCCTGGTGGGATTCCTTCACCAATT
ACTTTAATTAAAAATGGCTGCAACTGTAAGAACCCTTGTCTGATATATTTGCAACTATGCTCCCATTTACAAATG
TACCTTCTAATGCTCAGTTGCCAGGTTCCAATGCAAAGGTGGCGTGGACTCCCTTTGTGTGGGTGGGTTTGTGG
GTAGTGGTGAAGGACCGATATCAGAAAAATGCCTTCAAGTGTACTAATTTATTAATAAACATTAGGTGTTTGTTA
AAAAAAAAA
```

FIGURE 26

></usr/seqdb2/sst/DNA/Dnaseqs.min/ss.DNA52594
><subunit 1 of 1, 655 aa, 1 stop
><MW: 71845, pI: 8.22, NX(S/T): 8
MGTSPSSSTALASCSRIARRATATMIAGSLLLLGFLSTTTAQPEQKASNLIGTYRHVDRATG
QVLTCDKCPAGTYVSEHCTNTSLRVCSSCPVGTFTRHENGIEKCHDCSQPCPWPMIEKLPCA
ALTDRECTCPPGMFQSNATCAPHTVCPVGWGVRKKGTETEDVRCKQCARGTFSDVPSSVMKC
KAYTDCLSQNLVVIKPGTKETDNVCGTLPSFSSSTSPSPGTAIFPRPEHMETHEVPSSTYVP
KGMNSTESNSSASVRPKVLSSIQEGTVPDNTSSARGKEDVNKTLPNLQVVNHQQGPHHRHIL
KLLPSMEATGGEKSSTPIKGPKRGHPRQNLHKHFDINEHLPWMIVLFLLLVLVVIVVCSIRK
SSRTLKKGPRQDPSAIVEKAGLKKSMTPTQNREKWIYYCNGHGIDILKLVAAQVGSQWKDIY
QFLCNASEREVAAFSNGYTADHERAYAALQHWTIRGPEASLAQLISALRQHRRNDVVEKIRG
LMEDTTQLETDKLALPMSPSPLSPSPIPSPNAKLENSALLTVEPSPQDKNKGFFVDESEPLL
RCDSTSSGSSALSRNGSFITKEKKDTVLRQVRLDPCDLQPIFDDMLHFLNPEELRVIEEIPQ
AEDKLDRLFEIIGVKSQEASQTLLDSVYSHLPDLL

Signal sequence:
amino acids 1-41

Transmembrane domain:
amino acids 350-370

FIGURE 27

```
ATGGGAAGCCAGTAACACTGTGGCCTACTATCTCTTCCGTGGTGCCATCTACATTTTTGGGA
CTCGGGAATTATGAGGTAGAGGTGGAGGCGGAGCCGGATGTCAGAGGTCCTGAAATAGTCAC
CATGGGGGAAAATGATCCGCCTGCTGTTGAAGCCCCCTTCTCATTCCGATCGCTTTTTGGCC
TTGATGATTTGAAAATAAGTCCTGTTGCACCAGATGCAGATGCTGTTGCTGCACAGATCCTG
TCACTGCTGCCATTGAAGTTTTTTCCAATCATCGTCATTGGGATCATTGCATTGATATTAGC
ACTGGCCATTGGTCTGGGCATCCACTTCGACTGCTCAGGGAAGTACAGATGTCGCTCATCCT
TTAAGTGTATCGAGCTGATAGCTCGATGTGACGGAGTCTCGGATTGCAAAGACGGGGAGGAC
GAGTACCGCTGTGTCCGGGTGGGTGGTCAGAATGCCGTGCTCCAGGTGTTCACAGCTGCTTC
GTGGAAGACCATGTGCTCCGATGACTGGAAGGGTCACTACGCAAATGTTGCCTGTGCCCAAC
TGGGTTTCCCAAGCTATGTGAGTTCAGATAACCTCAGAGTGAGCTCGCTGGAGGGGCAGTTC
CGGGAGGAGTTTGTGTCCATCGATCACCTCTTGCCAGATGACAAGGTGACTGCATTACACCA
CTCAGTATATGTGAGGGAGGGATGTGCCTCTGGCCACGTGGTTACCTTGCAGTGCACAGCCT
GTGGTCATAGAAGGGGCTACAGCTCACGCATCGTGGGTGGAAACATGTCCTTGCTCTCGCAG
TGGCCCTGGCAGGCCAGCCTTCAGTTCCAGGGCTACCACCTGTGCGGGGCTCTGTCATCAC
GCCCCTGTGGATCATCACTGCTGCACACTGTGTTTATGACTTGTACCTCCCCAAGTCATGGA
CCATCCAGGTGGGTCTAGTTTCCCTGTTGGACAATCCAGCCCCATCCCACTTGGTGGAGAAG
ATTGTCTACCACAGCAAGTACAAGCCAAAGAGGCTGGGCAATGACATCGCCCTTATGAAGCT
GGCCGGGCCACTCACGTTCAATGAAATGATCCAGCCTGTGTGCCTGCCCAACTCTGAAGAGA
ACTTCCCCGATGGAAAAGTGTGCTGGACGTCAGGATGGGGGGCCACAGAGGATGGAGGTGAC
GCCTCCCCTGTCCTGAACCACGCGGCCGTCCCTTTGATTTCCAACAAGATCTGCAACCACAG
GGACGTGTACGGTGGCATCATCTCCCCCTCCATGCTCTGCGCGGGCTACCTGACGGGTGGCG
TGGACAGCTGCCAGGGGACAGCGGGGGGCCCTGGTGTGTCAAGAGAGGAGGCTGTGGAAG
TTAGTGGGAGCGACCAGCTTTGGCATCGGCTGCGCAGAGGTGAACAAGCCTGGGGTGTACAC
CCGTGTCACCTCCTTCCTGGACTGGATCCACGAGCAGATGGAGAGAGACCTAAAAACCTGAA
GAGGAAGGGGACAAGTAGCCACCTGAGTTCCTGAGGTGATGAAGACAGCCCGATCCTCCCCT
GGACTCCCGTGTAGGAACCTGCACACGAGCAGACACCCTTGGAGCTCTGAGTTCCGGCACCA
GTAGCAGGCCCGAAAGAGGCACCCTTCCATCTGATTCCAGCACAACCTTCAAGCTGCTTTTT
GTTTTTTGTTTTTTTGAGGTGGAGTCTCGCTCTGTTGCCCAGGCTGGAGTGCAGTGGCGAAA
TCCCTGCTCACTGCAGCCTCCGCTTCCCTGGTTCAAGCGATTCTCTTGCCTCAGCTTCCCCA
GTAGCTGGGACCACAGGTGCCCGCCACCACACCCAACTAATTTTGTATTTTTAGTAGAGAC
AGGGTTTCACCATGTTGGCCAGGCTGCTCTCAAACCCCTGACCTCAAATGATGTGCCTGCTT
CAGCCTCCCACAGTGCTGGGATTACAGGCATGGGCCACCACGCCTAGCCTCACGCTCCTTTC
TGATCTTCACTAAGAACAAAAGAAGCAGCAACTTGCAAGGGCGGCCTTTCCCACTGGTCCAT
CTGGTTTTCTCTCCAGGGTCTTGCAAAATTCCTGACGAGATAAGCAGTTATGTGACCTCACG
TGCAAAGCCACCAACAGCCACTCAGAAAGACGCACCAGCCCAGAAGTGCAGAACTGCAGTC
ACTGCACGTTTTCATCTCTAGGGACCAGAACCAAACCCACCCTTTCTACTTCCAAGACTTAT
TTTCACATGTGGGGAGGTTAATCTAGGAATGACTCGTTTAAGGCCTATTTTCATGATTTCTT
TGTAGCATTTGGTGCTTGACGTATTATTGTCCTTTGATTCCAAATAATATGTTTCCTTCCCT
CATTGTCTGGCGTGTCTGCGTGGACTGGTGACGTGAATCAAAATCATCCACTGAAA
```

FIGURE 28

></usr/seqdb2/sst/DNA/Dnaseqs.min/ss.DNA45234
><subunit 1 of 1, 453 aa, 1 stop
><MW: 49334, pI: 6.32, NX(S/T): 1

MGENDPPAVEAPFSFRSLFGLDDLKISPVAPDADAVAAQILSLLPLKFFPIIVIGIIALILA
LAIGLGIHFDCSGKYRCRSSFKCIELIARCDGVSDCKDGEDEYRCVRVGGQNAVLQVFTAAS
WKTMCSDDWKGHYANVACAQLGFPSYVSSDNLRVSSLEGQFREEFVSIDHLLPDDKVTALHH
SVYVREGCASGHVVTLQCTACGHRRGYSSRIVGGNMSLLSQWPWQASLQFQGYHLCGGSVIT
PLWIITAAHCVYDLYLPKSWTIQVGLVSLLDNPAPSHLVEKIVYHSKYKPKRLGNDIALMKL
AGPLTFNEMIQPVCLPNSEENFPDGKVCWTSGWGATEDGGDASPVLNHAAVPLISNKICNHR
DVYGGIISPSMLCAGYLTGGVDSCQGDSGGPLVCQERRLWKLVGATSFGIGCAEVNKPGVYT
RVTSFLDWIHEQMERDLKT

Signal Peptide:
amino acids 1-20

Transmembrane domain:
amino acids 240-284

FIGURE 29

```
CCCACGCGTCCGTCCTAGTCCCCGGGCCAACTCGGACAGTTTGCTCATTTATTGCAACGGTCAAGGCTGGCTTGT
GCCAGAACGGCGCGCGCGCGCACGCACGCACACACACGGGGGGAAACTTTTTTAAAAATGAAAGGCTAGAAGA
GCTCAGCGGCGGCGCGGGCGCTGCGCGAGGGCTCCGGAGCTGACTCGCCGAGGCAGGAAATCCCTCCGGTCGCGA
CGCCCGGCCCCGGCTCGGCGCCCGCGTGGGATGGTGCAGCGCTCGCCGCCGGGCCCGAGAGCTGCTGCACTGAAG
GCCGGCGACGATGGCAGCGCGCCCGCTGCCCGTGTCCCCGCCCGCGCCCTCCTGCTCGCCCTGGCCGGTGCTCT
GCTCGCGCCCTGCGAGGCCCGAGGGGTGAGCTTATGGAACCAAGGAAGAGCTGATGAAGTTGTCAGTGCCTCTGT
TCGGAGTGGGGACCTCTGGATCCCAGTGAAGAGCTTCGACTCCAAGAATCATCCAGAAGTGCTGAATATTCGACT
ACAACGGGAAAGCAAAGAACTGATCATAAATCTGGAAAGAAATGAAGGTCTCATTGCCAGCAGTTTCACGGAAAC
CCACTATCTGCAAGACGGTACTGATGTCTCCCTCGCTCGAAATTACACGGGTCACTGTTACTACCATGGACATGT
ACGGGGATATTCTGATTCAGCAGTCAGTCTCAGCACGTGTTCTGGTCTCAGGGGACTTATTGTGTTTGAAAATGA
AAGCTATGTCTTAGAACCAATGAAAAGTGCAACCAACAGATACAAACTCTTCCCAGCGAAGAAGCTGAAAAGCGT
CCGGGGATCATGTGGATCACATCACAACACACCAAACCTCGCTGCAAAGAATGTGTTTCCACCACCCTCTCAGAC
ATGGGCAAGAAGGCATAAAAGAGAGACCCTCAAGGCAACTAAGTATGTGGAGCTGGTGATCGTGGCAGACAACCG
AGAGTTTCAGAGGCAAGGAAAAGATCTGGAAAAAGTTAAGCAGCGATTAATAGAGATTGCTAATCACGTTGACAA
GTTTTACAGACCACTGAACATTCGGATCGTGTTGGTAGGCGTGGAAGTGTGGAATGACATGGACAAATGCTCTGT
AAGTCAGGACCCATTCACCAGCCTCCATGAATTTCTGGACTGGAGGAAGATGAAGCTTCTACCTCGCAAATCCCA
TGACAATGCGCAGCTTGTCAGTGGGGTTTATTTCCAAGGGACCACCATCGGCATGGCCCCAATCATGAGCATGTG
CACGGCAGACCAGTCTGGGGGAATTGTCATGGACCATTCAGACAATCCCCTTGGTGCAGCCGTGACCCTGGCACA
TGAGCTGGGCCACAATTTCGGGATGAATCATGACACACTGGACAGGGGCTGTAGCTGTCAAATGGCGGTTGAGAA
AGGAGGCTGCATCATGAACGCTTCCACCGGGTACCCATTTCCCATGGTGTTCAGCAGTTGCAGCAGGAAGGACTT
GGAGACCAGCCTGGAGAAAGGAATGGGGGTGTGCCTGTTTAACCTGCCGGAAGTCAGGGAGTCTTTCGGGGGCCA
GAAGTGTGGGAACAGATTTGTGGAAGAAGGAGAGGAGTGTGACTGTGGGGAGCCAGAGGAATGTATGAATCGCTG
CTGCAATGCCACCACCTGTACCCTGAAGCCGGACGCTGTGTGCGCACATGGGCTGTGCTGTGAAGACTGCCAGCT
GAAGCCTGCAGGAACAGCGTGCAGGGACTCCAGCAACTCCTGTGACCTCCCAGAGTTCTGCACAGGGGCCAGCCC
TCACTGCCCAGCCAATGTGTACCTGCACGATGGGCACTCATGTCAGGATGTGGACGGCTACTGCTACAATGGCAT
CTGCCAGACTCACGAGCAGCAGTGTGTCACGCTCTGGGGACCAGGTGCTAAACCTGCCCCTGGGATCTGCTTTGA
GAGAGTCAATTCTGCAGGTGATCCTTATGGCAACTGTGGCAAAGTCTCGAAGAGTTCCTTTGCCAAATGCGAGAT
GAGAGATGCTAAATGTGGAAAAATCCAGTGTCAAGGAGGTGCCAGCCGGCCAGTCATTGGTACCAATGCCGTTTC
CATAGAAACAAACATCCCTCTGCAGCAAGGAGGCCGGATTCTGTGCCGGGGACCCACGTGTACTTGGGCGATGA
CATGCCGGACCCAGGGCTTGTGCTTGCAGGCACAAAGTGTGCAGATGGAAAAATCTGCCTGAATCGTCAATGTCA
AAATATTAGTGTCTTTGGGGTTCACGAGTGTGCAATGCAGTGCCACGGCAGAGGGTGTGCAACAACAGGAAGAA
CTGCCACTGCGAGGCCCACTGGGCACCTCCCTTCTGTGACAAGTTTGGCTTTGGAGGAAGCACAGACAGCGGCCC
CATCCGCAAGCAGAAGCAAGGCAGGAAGCTGCAGAGTCCAACAGGGAGCGCGGCCAGGAGCCAGGAGCCCGTGGG
ATCGCAGGAGCATGCGTCTACTGCCTCACTGACACTCATCTGAGCCCTCCCATGACATGGAGACCGTGACCAGTG
CTGCTGCAGAGGAGGTCACGCGTCCCCAAGGCCTCCTGTGACTGGCAGCATTGACTCTGTGGCTTTGCCATCGTT
TCCATGACAACAGACACAACACAGTTCTCGGGGCTCAGGAGGGGAAGTCCAGCCTACCAGGCACGTCTGCAGAAA
CAGTGCAAGGAAGGGCAGCGACTTCCTGGTTGAGCTTCTGCTAAAACATGGACATGCTTCAGTGCTGCTCCTGAG
AGAGTAGCAGGTTACCACTCTGGCAGGCCCCAGCCCTGCAGCAAGGAGGAAGAGGACTCAAAAGTCTGGCCTTTC
ACTGAGCCTCCACAGCAGTGGGGGAGAAGCAAGGGTTGGGCCCAGTGTCCCCTTTCCCAGTGACACCTCAGCCT
TGGCAGCCCTGATGACTGGTCTCTGGCTGCAACTTAATGCTCTGATATGGCTTTTAGCATTTATTATATGAAAAT
AGCAGGGTTTTAGTTTTTAATTTATCAGAGACCCTGCCACCCATTCCATCTCCATCCAAGCAAACTGAATGGCAA
TGAAACAAACTGGAGAAGAAGGTAGGAGAAAGGGCGGTGAACTCTGGCTCTTTGCTGTGGACATGCGTGACCAGC
AGTACTCAGGTTTGAGGGTTTGCAGAAAGCCAGGGAACCCACAGAGTCACCAACCCTTCATTTAACAAGTAAGAA
TGTTAAAAAGTGAAAACAATGTAAGAGCCTAACTCCATCCCCCGTGGCCATTACTGCATAAAATAGAGTGCATTT
GAAAT
```

FIGURE 30

></usr/seqdb2/sst/DNA/Dnaseqs.min/ss.DNA49624
><subunit 1 of 1, 735 aa, 1 stop
><MW: 80177, pI: 7.08, NX(S/T): 5

MAARPLPVSPARALLLALAGALLAPCEARGVSLWNQGRADEVVSASVRSGDLWIPVKSFDSK
NHPEVLNIRLQRESKELIINLERNEGLIASSFTETHYLQDGTDVSLARNYTGHCYYHGHVRG
YSDSAVSLSTCSGLRGLIVFENESYVLEPMKSATNRYKLFPAKKLKSVRGSCGSHHNTPNLA
AKNVFPPPSQTWARRHKRETLKATKYVELVIVADNREFQRQGKDLEKVKQRLIEIANHVDKF
YRPLNIRIVLVGVEVWNDMDKCSVSQDPFTSLHEFLDWRKMKLLPRKSHDNAQLVSGVYFQG
TTIGMAPIMSMCTADQSGGIVMDHSDNPLGAAVTLAHELGHNFGMNHDTLDRGCSCQMAVEK
GGCIMNASTGYPFPMVFSSCSRKDLETSLEKGMGVCLFNLPEVRESFGGQKCGNRFVEEGEE
CDCGEPEECMNRCCNATTCTLKPDAVCAHGLCCEDCQLKPAGTACRDSSNSCDLPEFCTGAS
PHCPANVYLHDGHSCQDVDGYCYNGICQTHEQQCVTLWGPGAKPAPGICFERVNSAGDPYGN
CGKVSKSSFAKCEMRDAKCGKIQCQGGASRPVIGTNAVSIETNIPLQQGGRILCRGTHVYLG
DDMPDPGLVLAGTKCADGKICLNRQCQNISVFGVHECAMQCHGRGVCNNRKNCHCEAHWAPP
FCDKFGFGGSTDSGPIRQAEARQEAAESNRERGQGQEPVGSQEHASTASLTLI

Signal peptide:
amino acids 1-28

FIGURE 31

TCCCAAGGCTTCTTGGATGGCAGATGATTNTGGGGTTTTGCATTGTTTCCCTGACAACGAAA
ACAAAACAGTTTTGGGGGTTCAGGAGGGGAANTCCAGCCTACCCAGGAAGTTTGCAGAAACA
GTGCAAGGAAGGGCAGGANTTCCTGGTTGAGNTTTTTGNTAAAACATGGACATGNTTCAGTG
CTGCTCNTGAGAGAGTAGCAGGTTACCACTTTTGGCAGGCCCCAGCCCTGCAGCAAGGAGGA
AGAGGACTCAAAAGTTTGGCCTTTCACTGAGCCTCCACAGCAGTGGGGGAGAAGCAAGGGTT
GGGCCCAGTGTCCCCTTTCCCCAGTGACACCTCAGCCTTGGCAGCCCTGATAACTGGTNTNT
GGCTGCAANTTAATGCTNTGATATGGCTTTTAGCATTTATTATATGAAAATAGCAGGGTTTT
AGTTTTTAATTTATCAGAGACCCTGCCACCCATTCCATNTCCATCCAAG

FIGURE 32

CATCCTGCAACATGGTGAAACCACGCCTGGCTAATTTTGTTGTATTTTTGGTAGAGATGGGA
TTTCACCGTGTTAGCCAGGATTGTCTCAATCTGACCTCATGATCTGCCCGCCTCGGCCTCCC
AAAGTGCTGGGATTACAGGCGAGTGCAACCACACCCGGCCACAAACTTTTTAAGAAGTTAAT
GAAACCATACCTTTTACATTTTTAATGACAGGAAAATGCTCACAATAATTGTTAACCCAAAA
TTCTGGATACAAAAGTACAATCTTTACTGTGTAAATACATGTATATGTACTATATGAAAATA
TACCAAATATCAATAATACTTATCTCTGGGTAAAAACCTCTTCTCATACCCTGTGCTAACAA
CTTTTAACAAAAAATTTGCATCACTTTTAAGAATCAAGAAAAATTTCTGAAGGTCATATGGG
ACAGAAAAAAAACCAAGGGAAAAATCACGCCACTTGGGAAAAAAGATTCGAAATCTGCCT
TTTTATAGATTTGTAATTAATAAGGTCCAGGCTTTCTAAGCAACTTAAATGTTTTGTTTCGA
ACAAAGTACTTGTCTGGATGTAGGAGGAAAGGGAGTGATGTCACTGCCATTATGATGCCCC
TTGAATATAAGACCCTACTTGCTATCTCCCTGCACCAGCCAGGAGCCACCCATCCTCCAGC
ACACTGAGCAGCAAGCTGGACACACGGCACACTGATCCAAATGGGTAAGGGGATGGTGGCGA
TGCTCATTCTGGGTCTGCTACTTCTGGCGCTGCTCCTACCCGTGCAGGTTTCTTCATTTGTT
CCTTTAACCAGTATGCCGGAAGCTACTGCAGCCGAAACCACAAAGCCCTCCAACAGTGCCCT
ACAGCCTACAGCCGGTCTCCTTGTGGTCTTGCTTGCCCTTCTACATCTCTACCATTAAGAGG
CAGGTCAAGAAACAGCTACAGTTCTCCAACCCATACACTAAAACCGAATCCAAATGGTGCCT
AGAAGTTCAATGTGGCAAGGAAAAAAACCAGGTCTTCATCAAATCTACTAATTTCACTCCTT
ATTAACAGAGAAACGCTTGAGAGTCTCAAACTGGACTGGTTTAAAGAGCATCTGAAGGATTT
GACTAGATGATAAATGCCTGTACTCCCAGTACTTTGGGAGGCCTAGGCCGGCGGATCACCTG
AGGTCAGGAGTTTGAGACTAACCTGGCCAAAATGGTGAAACCCCATCTGTACTAAAAATACA
AATATTGACTGGGCGTGGTGGTGAGTGCCTGTGATCCCAGCTACTCAGGTGGCTGAAGCAGG
ACAATCACTTGAACTCAGGAGGCAGAGGTTGCAGTGAGCTGAGATCGCGCTACTGCACTCTA
GCCTAGCCTGGGCAACAGAGTGAGACTTCGTCTCAAAAAAAAAAAAGCCAAGTGCAGTGGCT
CACGCCTGTAATCCCGGCACTTTGGGAGGCCGAGGTGGGCGGATCACGAGGTCAGGAGATCA
AGACCATCCTGGCTAATACAGTGAAACCCTGTCTCTACTAAAAATACAAAAAATTAGCCGGG
GATGGTGGCAGGCACCTGGAGTCCCAGCTACTCGGGAGGCTGAGGCAGGAGAATAGCGTGAA
CTCAGGAGGCGGAGCTTGCAGTGAGCCGAGATTGCGCTACTGCACTCCAGCCTGGGCGACAG
CGCGAGACTCCGTCTCAAAAAAAAAAAAAAAAAAAAAAAA

FIGURE 33

></usr/seqdb2/sst/DNA/Dnaseqs.min/ss.DNA48309
><subunit 1 of 1, 67 aa, 1 stop
><MW: 6981, pI: 7.47, NX(S/T): 0
MGKGMVAMLILGLLLLALLLPVQVSSFVPLTSMPEATAAETTKPSNSALQPTAGLLVVLLAL
LHLYH

Signal peptide:
amino acids 15-27

FIGURE 34

```
GCCGCGGCGAGAGCGCGCCCAGCCCCGCCGCGATGCCCGCGCGCCCAGGACGCCTCCTCCCGCTGCTGGCCCGGC
CGGCGGCCCTGACTGCGCTGCTGCTGCTGCTGGGCCATGGCGGCGGCGGGCGCTGGGGCGCCCGGGCCCAGG
AGGCGGCGGCGGCGGCGGACGGGCCCCCGCGGCAGACGGCGAGGACGGACAGGACCCGCACAGCAAGCACC
TGTACACGGCCGACATGTTCACGCACGGGATCCAGAGCGCCGCGCACTTCGTCATGTTCTTCGCGCCCTGGTGTG
GACACTGCCAGCGGCTGCAGCCGACTTGGAATGACCTGGGAGACAAATACAACAGCATGGAAGATGCCAAAGTCT
ATGTGGCTAAAGTGGACTGCACGGCCCACTCCGACGTGTGCTCCGCCCAGGGGGTGCGAGGATACCCCACCTTAA
AGCTTTTCAAGCCAGGCCAAGAAGCTGTGAAGTACCAGGGTCCTCGGGACTTCCAGACACTGGAAAACTGGATGC
TGCAGACACTGAACGAGGAGCCAGTGACACCAGAGCCGGAAGTGGAACCGCCCAGTGCCCCCGAGCTCAAGCAAG
GGCTGTATGAGCTCTCAGCAAGCAACTTTGAGCTGCACGTTGCACAAGGCGACCACTTTATCAAGTTCTTCGCTC
CGTGGTGTGGTCACTGCAAAGCCCTGGCTCCAACCTGGGAGCAGCTGGCTCTGGGCCTTGAACATTCCGAAACTG
TCAAGATTGGCAAGGTTGATTGTACACAGCACTATGAACTCTGCTCCGGAAACCAGGTTCGTGGCTATCCCACTC
TTCTCTGGTTCCGAGATGGGAAAAAGGTGGATCAGTACAAGGGAAAGCGGGATTTGGAGTCACTGAGGGAGTACG
TGGAGTCGCAGCTGCAGCGCACAGAGACTGGAGCGACGGAGACCGTCACGCCCTCAGAGGCCCCGGTGCTGGCAG
CTGAGCCCGAGGCTGACAAGGGCACTGTGTTGGCACTCACTGAAAATAACTTCGATGACACCATTGCAGAAGGAA
TAACCTTCATCAAGTTTTATGCTCCATGGTGTGGTCATTGTAAGACTCTGGCTCCTACTTGGGAGGAACTCTCTA
AAAAGGAATTCCCTGGTCTGGCGGGGGTCAAGATCGCCGAAGTAGACTGCACTGCTGAACGGAATATCTGCAGCA
AGTATTCGGTACGAGGCTACCCCACGTTATTGCTTTTCCGAGGAGGGAAGAAAGTCAGTGAGCACAGTGGAGGCA
GAGACCTTGACTCGTTACACCGCTTTGTCCTGAGCCAAGCGAAAGACGAACTTTAGGAACACAGTTGGAGGTCAC
CTCTCCTGCCCAGCTCCCGCACCCTGCGTTTAGGAGTTCAGTCCCACAGAGGCCACTGGGTTCCCAGTGGTGGCT
GTTCAGAAAGCAGAACATACTAAGCGTGAGGTATCTTCTTTGTGTGTGTGTTTTCCAAGCCAACACACTCTACAG
ATTCTTTATTAAGTTAAGTTTCTCTAAGTAAATGTGTAACTCATGGTCACTGTGTAAACATTTTCAGTGGCGATA
TATCCCCTTTGACCTTCTCTTGATGAAATTTACATGGTTTCCTTTGAGACTAAAATAGCGTTGAGGGAAATGAAA
TTGCTGGACTATTTGTGGCTCCTGAGTTGAGTGATTTTGGTGAAAGAAAGCACATCCAAAGCATAGTTTACCTGC
CCACGAGTTCTGGAAAGGTGGCCTTGTGGCAGTATTGACGTTCCTCTGATCTTAAGGTCACAGTTGACTCAATAC
TGTGTTGGTCCGTAGCATGGAGCAGATTGAAATGCAAAAACCCACACCTCTGGAAGATACCTTCACGGCCGCTGC
TGGAGCTTCTGTTGCTGTGAATACTTCTCTCAGTGTGAGAGGTTAGCCGTGATGAAAGCAGCGTTACTTCTGACC
GTGCCTGAGTAAGAGAATGCTGATGCCATAACTTTATGTGTCGATACTTGTCAAATCAGTTACTGTTCAGGGGAT
CCTTCTGTTTCTCACGGGGTGAAACATGTCTTTAGTTCCTCATGTTAACACGAAGCCAGAGCCCACATGAACTGT
TGGATGTCTTCCTTAGAAAGGGTAGGCATGGAAAATTCCACGAGGCTCATTCTCAGTATCTCATTAACTCATTGA
AAGATTCCAGTTGTATTTGTCACCTGGGGTGACAAGACCAGACAGGCTTTCCCAGGCCTGGGTATCCAGGGAGGC
TCTGCAGCCCTGCTGAAGGGCCCTAACTAGAGTTCTAGAGTTTCTGATTCTGTTTCTCAGTAGTCCTTTTAGAGG
CTTGCTATACTTGGTCTGCTTCAAGGAGGTCGACCTTCTAATGTATGAAGAATGGGATGCATTTGATCTCAAGAC
CAAAGACAGATGTCAGTGGGCTGCTCTGGCCCTGGTGTGCACGGCTGTGGCAGCTGTTGATGCCAGTGTCCTCTA
ACTCATGCTGTCCTTGTGATTAAACACCTCTATCTCCCTTGGGAATAAGCACATACAGGCTTAAGCTCTAAGATA
GATAGGTGTTTGTCCTTTTACCATCGAGCTACTTCCCATAATAACCACTTTGCATCCAACACTCTTCACCCACCT
CCCATACGCAAGGGGATGTGGATACTTGGCCCAAAGTAACTGGTGGTAGGAATCTTAGAAACAAGACCACTTATA
CTGTCTGTCTGAGGCAGAAGATAACAGCAGCATCTCGACCAGCCTCTGCCTTAAAGGAAATCTTTATTAATCACG
TATGGTTCACAGATAATTCTTTTTTTAAAAAAACCCAACCTCCTAGAGAAGCACAACTGTCAAGAGTCTTGTACA
CACAACTTCAGCTTTGCATCACGAGTCTTGTATTCCAAGAAAATCAAAGTGGTACAATTTGTTTGTTTACACTAT
GATACTTTCTAAATAAACTCTTTTTTTTTAA
```

FIGURE 35

></usr/seqdb2/sst/DNA/Dnaseqs.min/ss.DNA46776

><subunit 1 of 1, 432 aa, 1 stop

><MW: 47629, pI: 5.90, NX(S/T): 0

MPARPGRLLPLLARPAALTALLLLLLGHGGGGRWGARAQEAAAAAADGPPAADGEDGQDPHS
KHLYTADMFTHGIQSAAHFVMFFAPWCGHCQRLQPTWNDLGDKYNSMEDAKVYVAKVDCTAH
SDVCSAQGVRGYPTLKLFKPGQEAVKYQGPRDFQTLENWMLQTLNEEPVTPEPEVEPPSAPE
LKQGLYELSASNFELHVAQGDHFIKFFAPWCGHCKALAPTWEQLALGLEHSETVKIGKVDCT
QHYELCSGNQVRGYPTLLWFRDGKKVDQYKGKRDLESLREYVESQLQRTETGATETVTPSEA
PVLAAEPEADKGTVLALTENNFDDTIAEGITFIKFYAPWCGHCKTLAPTWEELSKKEFPGLA
GVKIAEVDCTAERNICSKYSVRGYPTLLLFRGGKKVSEHSGGRDLDSLHRFVLSQAKDEL

Signal sequence:

amino acids 1-32

FIGURE 36

CTTTTCTGAGGAACCACAGCAATGAATGGCTTTGCATCCTTGCTTCGAAGAAACCAATTTAT
CCTCCTGGTACTATTTCTTTTGCAAATTCAGAGTCTGGGTCTGGATATTGATAGCCGTCCTA
CCGCTGAAGTCTGTGCCACACACACAATTTCACCAGGACCCAAAGGAGATGATGGTGAAAAA
GGAGATCCAGGAGAAGAGGGAAAGCATGGCAAAGTGGGACGCATGGGGCCGAAAGGAATTAA
AGGAGAACTGGGTGATATGGGAGATCAGGGCAATATTGGCAAGACTGGGCCCATTGGGAAGA
AGGGTGACAAAGGGGAAAAAGGTTTGCTTGGAATACCTGGAGAAAAAGGCAAAGCAGGTACT
GTCTGTGATTGTGGAAGATACCGGAAATTTGTTGGACAACTGGATATTAGTATTGCTCGGCT
CAAGACATCTATGAAGTTTGTCAAGAATGTGATAGCAGGGATTAGGGAAACTGAAGAGAAAT
TCTACTACATCGTGCAGGAAGAGAAGAACTACAGGGAATCCCTAACCCACTGCAGGATTCGG
GGTGGAATGCTAGCCATGCCCAAGGATGAAGCTGCCAACACACTCATCGCTGACTATGTTGC
CAAGAGTGGCTTCTTTCGGGTGTTCATTGGCGTGAATGACCTTGAAAGGGAGGGACAGTACA
TGTCCACAGACAACACTCCACTGCAGAACTATAGCAACTGGAATGAGGGGGAACCCAGCGAC
CCCTATGGTCATGAGGACTGTGTGGAGATGCTGAGCTCTGGCAGATGGAATGACACAGAGTG
CCATCTTACCATGTACTTTGTCTGTGAGTTCATCAAGAAGAAAAAGTAACTTCCCTCATCCT
ACGTATTTGCTATTTTCCTGTGACCGTCATTACAGTTATTGTTATCCATCCTTTTTTTCCTG
ATTGTACTACATTTGATCTGAGTCAACATAGCTAGAAAATGCTAAACTGAGGTATGGAGCCT
CCATCATCAAAAAAAAAAAAAAAA

FIGURE 37

></usr/seqdb2/sst/DNA/Dnaseqs.min/ss.DNA50980
><subunit 1 of 1, 277 aa, 1 stop
><MW: 30645, pI: 7.47, NX(S/T): 2
MNGFASLLRRNQFILLVLFLLQIQSLGLDIDSRPTAEVCATHTISPGPKGDDGEKGDPGEEG
KHGKVGRMGPKGIKGELGDMGDQGNIGKTGPIGKKGDKGEKGLLGIPGEKGKAGTVCDCGRY
RKFVGQLDISIARLKTSMKFVKNVIAGIRETEEKFYYIVQEEKNYRESLTHCRIRGGMLAMP
KDEAANTLIADYVAKSGFFRVFIGVNDLEREGQYMSTDNTPLQNYSNWNEGEPSDPYGHEDC
VEMLSSGRWNDTECHLTMYFVCEFIKKKK

Signal peptide:
amino acids 1-25

FIGURE 38

```
GGTTCTATCGATTCGAATTCGGCCACACTGGCCGGATCCTCTAGAGATCCCTCGACCTCGAC
CCACGCGTCCGCTGCTCTCCGCCCGTGTGGAGTGGTGGGGGCCTGGGTGGGATGGGCGTGT
GCCAGCGCACGCGCGCTCCCTGGAAGGAGAAGTCTCAGCTAGAACGAGCGGCCCTAGGTTTT
CGGAAGGGAGGATCAGGGATGTTTGCGAGCGGCTGGAACCAGACGGTGCCGATAGAGGAAGC
GGGCTCCATGGCTGCCCTCCTGCTGCTGCCCCTGCTGCTGTTGCTACCGCTGCTGCTGCTGA
AGCTACACCTCTGGCCGCAGTTGCGCTGGCTTCCGGCGGACTTGGCCTTTGCGGTGCGAGCT
CTGTGCTGCAAAAGGGCTCTTCGAGCTCGCGCCCTGGCCGCGGCTGCCGCCGACCCGGAAGG
TCCCGAGGGGGGCTGCAGCCTGGCCTGGCGCCTCGCGGAACTGGCCCAGCAGCGCCGCGC
ACACCTTTCTCATTCACGGCTCGCGGCGCTTTAGCTACTCAGAGGCGGAGCGCGAGAGTAAC
AGGGCTGCACGCGCCTTCCTACGTGCGCTAGGCTGGGACTGGGGACCCGACGGCGGCGACAG
CGGCGAGGGGAGCGCTGGAGAAGGCGAGCGGGCAGCGCCGGGAGCCGGAGATGCAGCGGCCG
GAAGCGGCGCGGAGTTTGCCGGAGGGGACGGTGCCGCCAGAGGTGGAGGAGCCGCCGCCCCT
CTGTCACCTGGAGCAACTGTGGCGCTGCTCCTCCCCGCTGGCCCAGAGTTTCTGTGGCTCTG
GTTCGGGCTGGCCAAGGCCGGCCTGCGCACTGCCTTTGTGCCCACCGCCCTGCGCCGGGGCC
CCCTGCTGCACTGCCTCCGCAGCTGCGGCGCGCGCGCGCTGGTGCTGGCGCCAGAGTTTCTG
GAGTCCCTGGAGCCGGACCTGCCCGCCCTGAGAGCCATGGGGCTCCACCTGTGGGCTGCAGG
CCCAGGAACCCACCCTGCTGGAATTAGCGATTTGCTGGCTGAAGTGTCCGCTGAAGTGGATG
GGCCAGTGCCAGGATACCTCTCTTCCCCCAGAGCATAACAGACACGTGCCTGTACATCTTC
ACCTCTGGCACCACGGGCCTCCCCAAGGCTGCTCGGATCAGTCATCTGAAGATCCTGCAATG
CCAGGGCTTCTATCAGCTGTGTGGTGTCCACCAGGAAGATGTGATCTACCTCGCCCTCCCAC
TCTACCACATGTCCGGTTCCCTGCTGGGCATCGTGGGCTGCATGGGCATTGGGGCCACAGTG
GTGCTGAAATCCAAGTTCTCGGCTGGTCAGTTCTGGGAAGATTGCCAGCAGCACAGGGTGAC
GGTGTTCCAGTACATTGGGGAGCTGTGCCGATACCTTGTCAACCAGCCCCCGAGCAAGGCAG
AACGTGGCCATAAGGTCCGGCTGGCAGTGGGCAGCGGGCTGCGCCCAGATACCTGGGAGCGT
TTTGTGCGGCGCTTCGGGCCCTGCAGGTGCTGGAGACATATGGACTGACAGAGGGCAACGT
GGCCACCATCAACTACACAGGACAGCGGGGCGCTGTGGGCGTGCTTCCTGGCTTTACAAGC
ATATCTTCCCCTTCTCCTTGATTCGCTATGATGTCACCACAGGAGAGCCAATTCGGGACCCC
CAGGGGCACTGTATGGCCACATCTCCAGGTGAGCCAGGGCTGCTGGTGGCCCCGGTAAGCCA
GCAGTCCCCATTCCTGGGCTATGCTGGCGGGCCAGAGCTGGCCCAGGGGAAGTTGCTAAAGG
ATGTCTTCCGGCCTGGGGATGTTTTCTTCAACACTGGGGACCTGCTGGTCTGCGATGACCAA
GGTTTTCTCCGCTTCCATGATCGTACTGGAGACACCTTCAGGTGGAAGGGGAGAATGTGGC
CACAACCGAGGTGGCAGAGGTCTTCGAGGCCCTAGATTTTCTTCAGGAGGTGAACGTCTATG
GAGTCACTGTGCCAGGGCATGAAGGCAGGGCTGGAATGGCAGCCCTAGTTCTGCGTCCCCCC
CACGCTTTGGACCTTATGCAGCTCTACACCCACGTGTCTGAGAACTTGCCACCTTATGCCCG
GCCCCGATTCCTCAGGCTCCAGGAGTCTTTGGCCACCACAGAGACCTTCAAACAGCAGAAAG
TTCGGATGGCAAATGAGGGCTTCGACCCCAGCACCCTGTCTGACCCACTGTACGTTCTGGAC
CAGGCTGTAGGTGCCTACCTGCCCCTCACAACTGCCCGGTACAGCGCCCTCCTGGCAGGAAA
CCTTCGAATCTGAGAACTTCCACACCTGAGGCACCTGAGAGAGGAACTCTGTGGGGTGGGG
CCGTTGCAGGTGTACTGGGCTGTCAGGGATCTTTTCTATACCAGAACTGCGGTCACTATTTT
GTAATAAATGTGGCTGGAGCTGATCCAGCTGTCTCTGACCTAAAAAAAAAAAAAAAAAAAAA
AAAAAAAAAGGGCGGCCGCGACTCTAGAGTCGACCTGCAGTAGGGATAACAGGGTAATAAGC
TTGGCCGCCATGGCCCAACTTGTTTATTGCAG
```

FIGURE 39

></usr/seqdb2/sst/DNA/Dnaseqs.min/ss.DNA50913
><subunit 1 of 1, 730 aa, 1 stop
><MW: 78644, pI: 7.65, NX(S/T): 2
MGVCQRTRAPWKEKSQLERAALGFRKGGSGMFASGWNQTVPIEEAGSMAALLLLPLLLLLPL
LLLKLHLWPQLRWLPADLAFAVRALCCKRALRARALAAAAADPEGPEGGCSLAWRLAELAQQ
RAAHTFLIHGSRRFSYSEAERESNRAARAFLRALGWDWGPDGGDSGEGSAGEGERAAPGAGD
AAAGSGAEFAGGDGAARGGGAAAPLSPGATVALLLPAGPEFLWLWFGLAKAGLRTAFVPTAL
RRGPLLHCLRSCGARALVLAPEFLESLEPDLPALRAMGLHLWAAGPGTHPAGISDLLAEVSA
EVDGPVPGYLSSPQSITDTCLYIFTSGTTGLPKAARISHLKILQCQGFYQLCGVHQEDVIYL
ALPLYHMSGSLLGIVGCMGIGATVVLKSKFSAGQFWEDCQQHRVTVFQYIGELCRYLVNQPP
SKAERGHKVRLAVGSGLRPDTWERFVRRFGPLQVLETYGLTEGNVATINYTGQRGAVGRASW
LYKHIFPFSLIRYDVTTGEPIRDPQGHCMATSPGEPGLLVAPVSQQSPFLGYAGGPELAQGK
LLKDVFRPGDVFFNTGDLLVCDDQGFLRFHDRTGDTFRWKGENVATTEVAEVFEALDFLQEV
NVYGVTVPGHEGRAGMAALVLRPPHALDLMQLYTHVSENLPPYARPRFLRLQESLATTETFK
QQKVRMANEGFDPSTLSDPLYVLDQAVGAYLPLTTARYSALLAGNLRI

Type II transmembrane domain:
amino acids 45-65

Other transmembrane domain:
amino acids 379-398 cAMP- and cGMP-dependent protein kinase phosphorylation site
starting at amino acid 136

CUB domain protein motif
amino acids 254-261 putative AMP-binding domain siganture
amino acids 332-343

N-glycosylation sites
amino acids 37-40 and 483-486

FIGURE 40

```
CCTGTGTTAAGCTGAGGTTTCCCCTAGATCTCGTATATCCCCAACACATACCTCCACGCACA
CACATCCCCAAGAACCTCGAGCTCACACCAACAGACACACGCGCGCATACACACTCGCTCTC
GCTTGTCCATCTCCCTCCCGGGGGAGCCGGCGCGCGCTCCCACCTTTGCCGCACACTCCGGC
GAGCCGAGCCCGCAGCGCTCCAGGATTCTGCGGCTCGGAACTCGGATTGCAGCTCTGAACCC
CCATGGTGGTTTTTTAAACACTTCTTTTCCTTCTCTTCCTCGTTTTGATTGCACCGTTTCCA
TCTGGGGGCTAGAGGAGCAAGGCAGCAGCCTTCCCAGCCAGCCCTTGTTGGCTTGCCATCGT
CCATCTGGCTTATAAAAGTTTGCTGAGCGCAGTCCAGAGGGCTGCGCTGCTCGTCCCCTCGG
CTGGCAGAAGGGGGTGACGCTGGGCAGCGGCGAGGAGCGCGCCGCTGCCTCTGGCGGGCTTT
CGGCTTGAGGGGCAAGGTGAAGAGCGCACCGGCCGTGGGGTTTACCGAGCTGGATTTGTATG
TTGCACCATGCCTTCTTGGATCGGGGCTGTGATTCTTCCCCTCTTGGGCTGCTGCTCTCCC
TCCCCGCCGGGGCGGATGTGAAGGCTCGGAGCTGCGGAGAGGTCCGCCAGGCGTACGGTGCC
AAGGGATTCAGCCTGGCGGACATCCCCTACCAGGAGATCGCAGGGGAACACTTAAGAATCTG
TCCTCAGGAATATACATGCTGCACCACAGAAATGGAAGACAAGTTAAGCCAACAAAGCAAAC
TCGAATTTGAAAACCTTGTGGAAGAGACAAGCCATTTTGTGCGCACCACTTTTGTGTCCAGG
CATAAGAAATTTGACGAATTTTTCCGAGAGCTCCTGGAGAATGCAGAAAAGTCACTAAATGA
TATGTTTGTACGGACCTATGGCATGCTGTACATGCAGAATTCAGAAGTCTTCCAGGACCTCT
TCACAGAGCTGAAAAGGTACTACACTGGGGGTAATGTGAATCTGGAGGAAATGCTCAATGAC
TTTTGGGCTCGGCTCCTGGAACGGATGTTTCAGCTGATAAACCCTCAGTATCACTTCAGTGA
AGACTACCTGGAATGTGTGAGCAAATACACTGACCAGCTCAAGCCATTTGGAGACGTGCCCC
GGAAACTGAAGATTCAGGTTACCCGCGCCTTCATTGCTGCCAGGACCTTTGTCCAGGGGCTG
ACTGTGGGCAGAGAAGTTGCAAACCGAGTTTCCAAGGTCAGCCCAACCCCAGGGTGTATCCG
TGCCCTCATGAAGATGCTGTACTGCCCATACTGTCGGGGGCTTCCCACTGTGAGGCCCTGCA
ACAACTACTGTCTCAACGTCATGAAGGGCTGCTTGGCAAATCAGGCTGACCTCGACACAGAG
TGGAATCTGTTTATAGATGCAATGCTCTTGGTGGCAGAGCGACTGGAGGGGCCATTCAACAT
TGAGTCGGTCATGGACCCGATAGATGTCAAGATTTCTGAAGCCATTATGAACATGCAAGAA
ACAGCATGCAGGTGTCTGCAAAGGTCTTTCAGGGATGTGGTCAGCCCAAACCTGCTCCAGCC
CTCAGATCTGCCCGCTCAGCTCCTGAAAATTTTAATACACGTTTCAGGCCCTACAATCCTGA
GGAAAGACCAACAACTGCTGCAGGCACAAGCTTGGACCGGCTGGTCACAGACATAAAAGAGA
AATTGAAGCTCTCTAAAAAGGTCTGGTCAGCATTACCCTACACTATCTGCAAGGACGAGAGC
GTGACAGCGGGCACGTCCAACGAGGAGGAATGCTGGAACGGGCACAGCAAAGCCAGATACTT
GCCTGAGATCATGAATGATGGGCTCACCAACCAGATCAACAATCCCGAGGTGGATGTGGACA
TCACTCGGCCTGACACTTTCATCAGACAGCAGATTATGGCTCTCCGTGTGATGACCAACAAA
CTAAAAAACGCCTACAATGGCAATGATGTCAATTTCCAGGACACAAGTGATGAATCCAGTGG
CTCAGGGAGTGGCAGTGGGTGCATGGATGACGTGTGTCCCACGGAGTTTGAGTTTGTCACCA
CAGAGGCCCCCGCAGTGGATCCCGACCGGAGAGAGGTGGACTCTTCTGCAGCCCAGCGTGGC
CACTCCCTGCTCTCCTGGTCTCTCACCTGCATTGTCCTGGCACTGCAGAGACTGTGCAGATA
ATCTTGGGTTTTTGGTCAGATGAAACTGCATTTTAGCTATCTGAATGGCCAACTCACTTCTT
TTCTTACACTCTTGGACAATGGACCATGCCACAAAAACTTACCGTTTTCTATGAGAAGAGAG
CAGTAATGCAATCTGCCTCCCTTTTTGTTTTCCCAAAGAGTACCGGGTGCCAGACTGAACTG
CTTCCTCTTTCCTTCAGCTATCTGTGGGACCTTGTTTATTCTAGAGAATTCTTACTCAA
ATTTTTCGTACCAGGAGATTTTCTTACCTTCATTTGCTTTTATGCTGCAGAAGTAAAGGAAT
CTCACGTTGTGAGGGTTTTTTTTTTCTCATTTAAAAT
```

FIGURE 41

></usr/seqdb2/sst/DNA/Dnaseqs.min/ss.DNA50914
><subunit 1 of 1, 555 aa, 1 stop
><MW: 62736, pI: 5.36, NX(S/T): 0

MPSWIGAVILPLLGLLLSLPAGADVKARSCGEVRQAYGAKGFSLADIPYQEIAGEHLRICPQ
EYTCCTTEMEDKLSQQSKLEFENLVEETSHFVRTTFVSRHKKFDEFFRELLENAEKSLNDMF
VRTYGMLYMQNSEVFQDLFTELKRYYTGGNVNLEEMLNDFWARLLERMFQLINPQYHFSEDY
LECVSKYTDQLKPFGDVPRKLKIQVTRAFIAARTFVQGLTVGREVANRVSKVSPTPGCIRAL
MKMLYCPYCRGLPTVRPCNNYCLNVMKGCLANQADLDTEWNLFIDAMLLVAERLEGPFNIES
VMDPIDVKISEAIMNMQENSMQVSAKVFQGCGQPKPAPALRSARSAPENFNTRFRPYNPEER
PTTAAGTSLDRLVTDIKEKLKLSKKVWSALPYTICKDESVTAGTSNEEECWNGHSKARYLPE
IMNDGLTNQINNPEVDVDITRPDTFIRQQIMALRVMTNKLKNAYNGNDVNFQDTSDESSGSG
SGSGCMDDVCPTEFEFVTTEAPAVDPDRREVDSSAAQRGHSLLSWSLTCIVLALQRLCR

Signal peptide:
amino acids 1-23

FIGURE 42A

```
CGGACGCGTGGGCGGACGCGTGGGCAAAAGAACTCGGAGTGCCAAAGCTAAATAAGTTAGCTGAGAAAACGCACG
CAGTTTGCAGCGCCTGCGCCGGGTGCGCCAACTACGCAAAGACCAAGCGGGCTCCGCGCGGACCGGCCGCGGGGC
TAGGGACCCGGCTTTGGCCTTCAGGCTCCCTAGCAGCGGGGAAAAGGAATTGCTGCCCGGAGTTTCTGCGGAGGT
GGAGGGAGATCAGGAAACGGCTTCTTCCTCACTTCGCCGCCTGGTGAGTGTCGGGGAGATTGGCAAACGCCTAGG
AAAGGACTGGGGAAAATAGCCCTGGGAAAGTGGAGAAGGTGATCAGGAGGCCGGTCCACTACGGCAGTTTATCTG
TCTGATCAGAGCCAGACGCGACGCGTCCACTTCGCAGTTCTTTCCAGGTGTGGGGACCGCAGGACAGACGGCCGA
TCCCGCCGCCCTCCGTACCAGCACTCCCAGGAGAGTCAGCCTCGCTCCCCAACGTCGAGGGCGCTCTGGCCACGA
AAAGTTCCTGTCCACTGTGATTCTCAATTCCTTGCTTGGTTTTTTTCTCCAGAGAACTTTTGGGTGGAGATATTA
ACTTTTTTCTTTTTTTTTTCCTTGGTGGAAGCTGCTCTAGGGAGGGGGGAGGAGGAGGAGAAAGTGAAATGTGC
TGGAGAAGAGCGAGCCCTCCTTGTTCTTCCGGAGTCCCATCCATTAAGCCATCACTTCTGGAAGATTAAAGTTGT
CGGACATGGTGACAGCTGAGAGGAGAGGAGGATTTCTTGCCAGGTGGAGAGTCTTCACCGTCTGTTGGGTGCATG
TGTGCGCCCGCAGCGGCGCGGGGCGCGTGGTTCTCCGCGTGGAGTCTCACCTGGGACCTGAGTGAATGGCTCCCA
GGGGCTGTGCGGGGCATCCGCCTCCGCCTTCTCCACAGGCCTGTGTCTGTCCTGGAAAGATGCTAGCAATGGGGG
CGCTGGCAGGATTCTGGATCCTCTGCCTCCTCACTTATGGTTACCTGTCCTGGGGCCAGGCCTTAGAAGAGGAGG
AAGAAGGGGCCTTACTAGCTCAAGCTGGAGAGAAACTAGAGCCCAGCACAACTTCCACCTCCCAGCCCCATCTCA
TTTTCATCCTAGCGGATGATCAGGGATTTAGAGATGTGGGTTACCACGGATCTGAGATTAAAACACCTACTCTTG
ACAAGCTCGCTGCCGAAGGAGTTAAACTGGAGAACTACTATGTCCAGCCTATTTGCACACCATCCAGGAGTCAGT
TTATTACTGGAAAGTATCAGATACACACCGGACTTCAACATTCTATCATAAGACCTACCCAACCCAACTGTTTAC
CTCTGGACAATGCCACCCTACCTCAGAAACTGAAGGAGGTTGGATATTCAACGCATATGGTCGGAAAATGGCACT
TGGGTTTTAACAGAAAAGAATGCATGCCCACCAGAAGAGGATTTGATACCTTTTTGGTTCCCTTTTGGGAAGTG
GGGATTACTATACACTACAAATGTGACAGTCCTGGGATGTGTGGCTATGACTTGTATGAAAACGACAATGCTG
CCTGGGACTATGACAATGGCATATACTCCACACAGATGTACACTCAGAGAGTACAGCAAATCTTAGCTTCCCATA
ACCCCACAAAGCCTATATTTTTATATACTGCCTATCAAGCTGTTCATTCACCACTGCAAGCTCCTGGCAGGTATT
TCGAACACTACCGATCCATTATCAACATAAACAGGAGAAGATATGCTGCCATGCTTTCCTGCTTAGATGAAGCAA
TCAACAACGTGACATTGGCTCTAAAGACTTATGGTTTCTATAACAACAGCATTATCATTTACTCTTCAGATAATG
GTGGCCAGCCTACGGCAGGAGGGAGTAACTGGCCTCTCAGAGGTAGCAAAGGAACATATTGGGAAGGAGGGATCC
GGGCTGTAGGCTTTGTGCATAGCCCACTTCTGAAAAACAAGGGAACAGTGTGTAAGGAACTTGTGCACATCACTG
ACTGGTACCCCACTCTCATTTCACTGGCTGAAGGACAGATTGATGAGGACATTCAACTAGATGGCTATGATATCT
GGGAGACCATAAGTGAGGGTCTTCGCTCACCCCGAGTAGATATTTTGCATAACATTGACCCCTATACACCAAGGC
AAAAAATGGCTCCTGGGCAGCAGGCTATGGGATCTGGAACACTGCAATCCAGTCAGCCATCAGAGTGCAGCACTG
GAAATTGCTTACAGGAAATCCTGGCTACAGCGACTGGGTCCCCCCTCAGTCTTTCAGCAACCTGGGACCGAACCG
GTGGCACAATGAACGGATCACCTTGTCAACTGGCAAAAGTGTATGGCTTTTCAACATCACAGCCGACCCATATGA
GAGGGTGGACCTATCTAACAGGTATCCAGGAATCGTGAAGAAGCTCCTACGGAGGCTCTCACAGTTCAACAAAAC
TGCAGTGCCGGTCAGGTATCCCCCAAAGACCCCAGAAGTAACCCTAGGCTCAATGGAGGGGTCTGGGGACCATG
GTATAAAGAGGAAACCAAGAAAAGAAGCCAAGCAAAAATCAGGCTGAGAAAAAGCAAAAGAAAAGCAAAAAAA
GAAGAAGAAACAGCAGAAAGCAGTCTCAGGTAAACCAGCAAATTTGGCTCGATAATATCGCTGGCCTAAGCGTCA
GGCTTGTTTTCATGCTGTGCCACTCCAGAGACTTCTGCCACCTGGCCGCCACACTGAAAACTGTCCTGCTCAGTG
CCAAGGTGCTACTCTTGCAAGCCACACTTAGAGAGAGTGGAGATGTTTATTTCTCTCGCTCCTTTAGAAAACGTG
GTGAGTCCTGAGTTCCACTGCTGTGCTTCAGTCAACTGACCAAACACTGCTTTGAATTATAGGAGGAGAACAATA
ACCTACCATCCGCAAGCATGCTAATTTGATGGAAGTTACAGGGTAGCATGATTAAAACTACCTTTGATAAATTAC
```

FIGURE 42B

```
AGTCAAAGATTGTGTCACCTCAAAGGCCTTGAAGAATATATTTTCTTGGTGAATTTTTGTATGTCTGTCATATGA
CACTTGGGTTTTTTAATTAATTCTATTTTATATATATAAATATATGTTTCTTTTCCTGTGAAAAGCTGTTTTTCT
CACATGTGAACAGCTTGCACCTCATTTTACCATGCGTGAGGGAATGGCAAATAAGAATGTTTGAGCACACTGCCC
ACAATGAATGTAACTATTTTCTAAACACTTTACTAGAAGAACATTTCAGTATAAAAAACCTAATTTATTTTTACA
GAAAAATATTTTGTTGTTTTATAAAAAGTTATGCAAATGACTTTTATTTTTATTTCCTGCATACCATTAGAAGA
ATTTTATTTCATTTCTTCAAATTATCAAGCACTGTAATACTATAAATTAATGTAATACTGTGTGAATTCAGACTA
TAAAAAACATCATTCAGAAAACTTTATAATCGTCATTGTTCAATCAAGATTTTGAATGTAATAAGATGAATATAT
ATTACTTGGAAATTCAATGTTTGTGCAGAGTTGAGACAACTTTATTGTTTCTATCATAAACTATTTATGTATCTT
AATTATTAAATGATTTACTTTATGGCACTAGAAAATTTACTGTGGCTTTTCTGATCTAACTTCTAGCTAAAATT
GTATCATTGGTCCTAAAAAATAAAAATCTTTACTAATAGGCAATTGAAGGAATGGTTTGCTAACAACCACAGTAA
TATAATATGATTTTACAGATAGATGCTTCCCCTTGGCTATGACATGGAGAAAGATTTTCCCATAATAATAACTAA
TATTTATATTAGGTTGGTGCAAAACTAGTTGCGGTTTTTCCCATTAAAAGTAATAACCTTACTCTTATACAAAGT
GGACACTGTGGGGAGATACAGAGAAATGGAAGATACGGATCCTGCCTGGAGTAGGTAACCTTGCTTGGAAACCCC
ACATGCAAACGTCATGAGGAGAATTAAAGGAGTATTATCAGTAATGAAGTTTATCATGGGTCATCAATGAGCATA
GATTGGTGTGGATCCTGTAGACCCTGGTGTTTTCTTTGAAGTGCCCTCTCCTAATGCAGAGGCCTTGAAGCTTAC
AGTATACACTTGAAAAGTCACAGATAGCTAGAATTATGATCTTTGAAGTTATAACTGTGATCTGAAAATGTGTGT
GGTGGTATGACAGCATACCATTAAATACATTTACATCACAGCTCAAAGGACTGTGATATAATCCATTTATATCAC
AACTCAAAGGACTGTGATATAATCCATTTATATCACAGCTCACAGTTTCTGAAAATGTATAAAAGAATCTATAAT
CTAGTACTGAAATTACTAAATTGGGTAAGATGATTTAAATGATTTTAATTTTAACATTTTATTTCTAGAATATAT
GGCTCCATTTTATTTTATAGTGTAAAGTTGTATTTCCTAAAGTTTGTGTTTTGTCGACAGTATCTTTTAAATGAG
TCTTAAAAATAAAGGCATATTGTTCATGTTTAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAA
```

FIGURE 43

></usr/seqdb2/sst/DNA/Dnaseqs.min/ss.DNA48296
><subunit 1 of 1, 515 aa, 1 stop
><MW: 56885, pI: 6.49, NX(S/T): 5

MAPRGCAGHPPPPSPQACVCPGKMLAMGALAGFWILCLLTYGYLSWGQALEEEEEGALLAQA
GEKLEPSTTSTSQPHLIFILADDQGFRDVGYHGSEIKTPTLDKLAAEGVKLENYYVQPICTP
SRSQFITGKYQIHTGLQHSIIRPTQPNCLPLDNATLPQKLKEVGYSTHMVGKWHLGFNRKEC
MPTRRGFDTFFGSLLGSGDYYTHYKCDSPGMCGYDLYENDNAAWDYDNGIYSTQMYTQRVQQ
ILASHNPTKPIFLYTAYQAVHSPLQAPGRYFEHYRSIININRRRYAAMLSCLDEAINNVTLA
LKTYGFYNNSIIIYSSDNGGQPTAGGSNWPLRGSKGTYWEGGIRAVGFVHSPLLKNKGTVCK
ELVHITDWYPTLISLAEGQIDEDIQLDGYDIWETISEGLRSPRVDILHNIDPYTPRQKMAPG
QQAMGSGTLQSSQPSECSTGNCLQEILATATGSPLSLSATWDRTGGTMNGSPCQLAKVYGFS
TSQPTHMRGWTYLTGIQES

Important Features:

Signal Peptide:

amino acids 1-37

Sulfatases signature 1.

amino acids 120-132

Sulfatases signature 2.

amino acids 168-177

Tyrosine kinase phosphorylation site.

amino acids 163-169

N-glycosylation sites.

amino acids 157-160, 306-309 and 318-321

FIGURE 44

```
CGGACGCGTGGGTGCGAGTGGAGCGGAGGACCCGAGCGGCTGAGGAGAGAGGAGGCGGCGGC
TTAGCTGCTACGGGGTCCGGCCGGCGCCCTCCCGAGGGGGGCTCAGGAGGAGGAAGGAGGAC
CCGTGCGAGAATGCCTCTGCCCTGGAGCCTTGCGCTCCCGCTGCTGCTCTCCTGGGTGGCAG
GTGGTTTCGGGAACGCGGCCAGTGCAAGGCATCACGGGTTGTTAGCATCGGCACGTCAGCCT
GGGGTCTGTCACTATGGAACTAAACTGGCCTGCTGCTACGGCTGGAGAAGAAACAGCAAGGG
AGTCTGTGAAGCTACATGCGAACCTGGATGTAAGTTTGGTGAGTGCGTGGGACCAAACAAAT
GCAGATGCTTTCCAGGATACACCGGGAAAACCTGCAGTCAAGATGTGAATGAGTGTGGAATG
AAACCCCGGCCATGCCAACACAGATGTGTGAATACACACGGAAGCTACAAGTGCTTTTGCCT
CAGTGGCCACATGCTCATGCCAGATGCTACGTGTGTGAACTCTAGGACATGTGCCATGATAA
ACTGTCAGTACAGCTGTGAAGACACAGAAGAAGGGCCACAGTGCCTGTGTCCATCCTCAGGA
CTCCGCCTGGCCCCAAATGGAAGAGACTGTCTAGATATTGATGAATGTGCCTCTGGTAAAGT
CATCTGTCCCTACAATCGAAGATGTGTGAACACATTTGGAAGCTACTACTGCAAATGTCACA
TTGGTTTCGAACTGCAATATATCAGTGGACGATATGACTGTATAGATATAAATGAATGTACT
ATGGATAGCCATACGTGCAGCCACCATGCCAATTGCTTCAATACCCAAGGGTCCTTCAAGTG
TAAATGCAAGCAGGGATATAAAGGCAATGGACTTCGGTGTTCTGCTATCCCTGAAAATTCTG
TGAAGGAAGTCCTCAGAGCACCTGGTACCATCAAAGACAGAATCAAGAAGTTGCTTGCTCAC
AAAAACAGCATGAAAAGAAGGCAAAAATTAAAAATGTTACCCCAGAACCCACCAGGACTCC
TACCCCTAAGGTGAACTTGCAGCCCTTCAACTATGAAGAGATAGTTTCCAGAGGCGGGAACT
CTCATGGAGGTAAAAAAGGGAATGAAGAGAAATGAAAGAGGGGCTTGAGGATGAGAAAAGAG
AAGAGAAAGCCCTGAAGAATGACATAGAGGAGCGAAGCCTGCGAGGAGATGTGTTTTTCCCT
AAGGTGAATGAAGCAGGTGAATTCGGCCTGATTCTGGTCCAAAGGAAAGCGCTAACTTCCAA
ACTGGAACATAAAGATTTAAATATCTCGGTTGACTGCAGCTTCAATCATGGGATCTGTGACT
GGAAACAGGATAGAGAAGATGATTTTGACTGGAATCCTGCTGATCGAGATAATGCTATTGGC
TTCTATATGGCAGTTCCGGCCTTGGCAGGTCACAAGAAAGACATTGGCCGATTGAAACTTCT
CCTACCTGACCTGCAACCCCAAAGCAACTTCTGTTTGCTCTTTGATTACCGGCTGGCCGGAG
ACAAAGTCGGGAACTTCGAGTGTTTGTGAAAAACAGTAACAATGCCCTGGCATGGGAGAAG
ACCACGAGTGAGGATGAAAAGTGGAAGACAGGGAAATTCAGTTGTATCAAGGAACTGATGC
TACCAAAAGCATCATTTTTGAAGCAGAACGTGGCAAGGGCAAAACCGGCGAAATCGCAGTGG
ATGGCGTCTTGCTTGTTTCAGGCTTATGTCCAGATAGCCTTTTATCTGTGGATGACTGAATG
TTACTATCTTTATATTTGACTTTGTATGTCAGTTCCCTGGTTTTTTTGATATTGCATCATAG
GACCTCTGGCATTTTAGAATTACTAGCTGAAAAATTGTAATGTACCAACAGAAATATTATTG
TAAGATGCCTTTCTTGTATAAGATATGCCAATATTTGCTTTAAATATCATATCACTGTATCT
TCTCAGTCATTTCTGAATCTTTCCNCATTATATTATAAAATNTGGAAANGTCAGTTTATCTC
CCCTCCTCNGTATATCTGATTTGTATANGTANGTTGATGNGCTTCTCTCTACAACATTTCTA
GAAAATAGAAAAAAAGCACAGAGAAATGTTTAACTGTTTGACTCTTATGATACTTCTTGGA
AACTATGACATCAAAGATAGACTTTTGCCTAAGTGGCTTAGCTGGGTCTTTCATAGCCAAAC
TTGTATATTTAATTCTTTGTAATAATAA
```

FIGURE 45

MPLPWSLALPLLLSWVAGGFGNAASARHHGLLASARQPGVCHYGTKLACCYGWRRNSKGVCE
ATCEPGCKFGECVGPNKCRCFPGYTGKTCSQDVNECGMKPRPCQHRCVNTHGSYKCFCLSGH
MLMPDATCVNSRTCAMINCQYSCEDTEEGPQCLCPSSGLRLAPNGRDCLDIDECASGKVICP
YNRRCVNTFGSYYCKCHIGFELQYISGRYDCIDINECTMDSHTCSHHANCFNTQGSFKCKCK
QGYKGNGLRCSAIPENSVKEVLRAPGTIKDRIKKLLAHKNSMKKKAKIKNVTPEPTRTPTPK
VNLQPFNYEEIVSRGGNSHGGKKGNEEK

Signal peptide:
amino acids 1-21

EGF-like domain cysteine pattern signature.
amino acids 80-91

Calcium-binding EGF-like domains
amino acids 103-124, 230-251 and 185-206

FIGURE 46

```
GGGAGCTGCTGCTGTGGCTGCTGGTGCTGTGCGCGCTGCTCCTGCTCTTGGTGCAGCTGCTG
CGCTTCCTGAGGGCTGACGGCGACCTGACGCTACTATGGGCCGAGTGGCAGGGACGACGCCC
AGAATGGGAGCTGACTGATATGGTGGTGTGGGTGACTGGAGCCTCGAGTGGAATTGGTGAGG
AGCTGGCTTACCAGTTGTCTAAACTAGGAGTTTCTCTTGTGCTGTCAGCCAGAAGAGTGCAT
GAGCTGGAAAGGGTGAAAAGAAGATGCCTAGAGAATGGCAATTTAAAAGAAAAGATATACT
TGTTTTGCCCCTTGACCTGACCGACACTGGTTCCCATGAAGCGGCTACCAAAGCTGTTCTCC
AGGAGTTTGGTAGAATCGACATTCTGGTCAACAATGGTGGAATGTCCCAGCGTTCTCTGTGC
ATGGATACCAGCTTGGATGTCTACAGAAAGCTAATAGAGCTTAACTACTTAGGGACGGTGTC
CTTGACAAAATGTGTTCTGCCTCACATGATCGAGAGGAAGCAAGGAAAGATTGTTACTGTGA
ATAGCATCCTGGGTATCATATCTGTACCTCTTTCCATTGGATACTGTGCTAGCAAGCATGCT
CTCCGGGGTTTTTTTAATGGCCTTCGAACAGAACTTGCCACATACCCAGGTATAATAGTTTC
TAACATTTGCCCAGGACCTGTGCAATCAAATATTGTGGAGAATTCCCTAGCTGGAGAAGTCA
CAAAGACTATAGGCAATAATGGAGACCAGTCCCACAAGATGACAACCAGTCGTTGTGTGCGG
CTGATGTTAATCAGCATGGCCAATGATTTGAAAGAAGTTTGGATCTCAGAACAACCTTTCTT
GTTAGTAACATATTTGTGGCAATACATGCCAACCTGGGCCTGGTGGATAACCAACAAGATGG
GGAAGAAAAGGATTGAGAACTTTAAGAGTGGTGTGGATGCAGACTCTTCTTATTTTAAAATC
TTTAAGACAAAACATGACTGAAAAGAGCACCTGTACTTTTCAAGCCACTGGAGGGAGAAATG
GAAAACATGAAAACAGCAATCTTCTTATGCTTCTGAATAATCAAAGACTAATTTGTGATTTT
ACTTTTTAATAGATATGACTTTGCTTCCAACATGGAATGAAATAAAAAATAAATAATAAAAG
ATTGCCATGAATCTTGCAAAA
```

FIGURE 47

></usr/seqdb2/sst/DNA/Dnaseqs.min/ss.DNA36343
><subunit 1 of 1, 289 aa, 1 stop
><MW: 32268, pI: 9.21, NX(S/T): 0
MVVWVTGASSGIGEELAYQLSKLGVSLVLSARRVHELERVKRRCLENGNLKEKDILVLPLDL
TDTGSHEAATKAVLQEFGRIDILVNNGGMSQRSLCMDTSLDVYRKLIELNYLGTVSLTKCVL
PHMIERKQGKIVTVNSILGIISVPLSIGYCASKHALRGFFNGLRTELATYPGIIVSNICPGP
VQSNIVENSLAGEVTKTIGNNGDQSHKMTTSRCVRLMLISMANDLKEVWISEQPFLLVTYLW
QYMPTWAWWITNKMGKKRIENFKSGVDADSSYFKIFKTKHD Important Features:

Signal Peptide:
amino acids 1-31

Transmembrane domain:
amino acids 136-157

Tyrosine kinase phosphorylation site.
106-113 and 107-114

Homologous region to Short-chain alcohol dehydrogenase
amino acids 80-90, 131-168, 1-13 and 176-185

FIGURE 48

```
GCGACGTGGGCACCGCCATCAGCTGTTCGCGCGTCTTCTCCTCCAGGTGGGGCAGGGGTTTC
GGGCTGGTGGAGCATGTGCTGGGACAGGACAGCATCCTCAATCAATCCAACAGCATATTCGG
TTGCATCTTCTACACACTACAGCTATTGTTAGGTTGCCTGCGGACACGCTGGGCCTCTGTCC
TGATGCTGCTGAGCTCCCTGGTGTCTCTCGCTGGTTCTGTCTACCTGGCCTGGATCCTGTTC
TTCGTGCTCTATGATTTCTGCATTGTTTGTATCACCACCTATGCTATCAACGTGAGCCTGAT
GTGGCTCAGTTTCCGGAAGGTCCAAGAACCCCAGGGCAAGGCTAAGAGGCACTGAGCCCTCA
ACCCAAGCCAGGCTGACCTCATCTGCTTTGCTTTGGTCTTCAAGCCGCTCAGCGTGCCTGTG
GACAGCGTGGCCCCGGCCCCCCCAAGCCTCAGGAGGGCAACACAGTCCCTGGCGAGTGGCCC
TGGCAGGCCAGTGTGAGGAGGCAAGGAGCCCACATCTGCAGCGGCTCCCTGGTGGCAGACAC
CTGGGTCCTCACTGCTGCCCACTGCTTTGAAAAGGCAGCAGCAACAGAACTGAATTCCTGGT
CAGTGGTCCTGGGTTCTCTGCAGCGTGAGGGACTCAGCCCTGGGGCCGAAGAGGTGGGGGTG
GCTGCCCTGCAGTTGCCCAGGGCCTATAACCACTACAGCCAGGGCTCAGACCTGGCCCTGCT
GCAGCTCGCCCACCCCACGACCCACACACCCCTCTGCCTGCCCCAGCCCGCCCATCGCTTCC
CCTTTGGAGCCTCCTGCTGGGCCACTGGCTGGGATCAGGACACCAGTGATGCTCCTGGGACC
CTACGCAATCTGCGCCTGCGTCTCATCAGTCGCCCCACATGTAACTGTATCTACAACCAGCT
GCACCAGCGACACCTGTCCAACCCGGCCCGGCCTGGGATGCTATGTGGGGCCCCCAGCCTG
GGGTGCAGGGCCCCTGTCAGGGAGATTCCGGGGCCCTGTGCTGTGCCTCGAGCCTGACGGA
CACTGGGTTCAGGCTGGCATCATCAGCTTTGCATCAAGCTGTGCCCAGGAGGACGCTCCTGT
GCTGCTGACCAACACAGCTGCTCACAGTTCCTGGCTGCAGGCTCGAGTTCAGGGGCAGCTT
TCCTGGCCCAGAGCCCAGAGACCCCGGAGATGAGTGATGAGGACAGCTGTGTAGCCTGTGGA
TCCTTGAGGACAGCAGGTCCCCAGGCAGGAGCACCCTCCCCATGGCCCTGGGAGGCCAGGCT
GATGCACCAGGGACAGCTGGCCTGTGGCGGAGCCCTGGTGTCAGAGGAGGCGGTGCTAACTG
CTGCCCACTGCTTCATTGGGCGCCAGGCCCCAGAGGAATGGAGCGTAGGGCTGGGGACCAGA
CCGGAGGAGTGGGGCCTGAAGCAGCTCATCCTGCATGGAGCCTACACCCACCCTGAGGGGGG
CTACGACATGGCCCTCCTGCTGCTGGCCCAGCCTGTGACACTGGGAGCCAGCCTGCGGCCCC
TCTGCCTGCCCTATCCTGACCACCACCTGCCTGATGGGGAGCGTGGCTGGGTTCTGGGACGG
GCCCGCCCAGGAGCAGGCATCAGCTCCCTCCAGACAGTGCCCGTGACCCTCCTGGGGCCTAG
GGCCTGCAGCCGGCTGCATGCAGCTCCTGGGGGTGATGGCAGCCCTATTCTGCCGGGGATGG
TGTGTACCAGTGCTGTGGGTGAGCTGCCCAGCTGTGAGGGCCTGTCTGGGGCACCACTGGTG
CATGAGGTGAGGGGCACATGGTTCCTGGCCGGGCTGCACAGCTTCGGAGATGCTTGCCAAGG
CCCCGCCAGGCCGGCGGTCTTCACCGCGCTCCCTGCCTATGAGGACTGGGTCAGCAGTTTGG
ACTGGCAGGTCTACTTCGCCGAGGAACCAGAGCCCGAGGCTGAGCCTGGAAGCTGCCTGGCC
AACATAAGCCAACCAACCAGCTGCTGACAGGGGACCTGGCCATTCTCAGGACAAGAGAATGC
AGGCAGGCAAATGGCATTACTGCCCCTGTCCTCCCCACCCTGTCATGTGTGATTCCAGGCAC
CAGGGCAGGCCCAGAAGCCCAGCAGCTGTGGGAAGGAACCTGCCTGGGGCCACAGGTGCCCA
CTCCCCACCCTGCAGGACAGGGTGTCTGTGGACACTCCCACACCCAACTCTGCTACCAAGC
AGGCGTCTCAGCTTTCCTCCTCCTTTACTCTTTCAGATACAATCACGCCAGCCACGTTGTTT
TGAAAATTTCTTTTTTTGGGGGGCAGCAGTTTTCCTTTTTTTAAACTTAAATAAATTGTTAC
AAAATAAAA
```

FIGURE 49

```
></usr/seqdb2/sst/DNA/Dnaseqs.min/ss.DNA40571
MLLSSLVSLAGSVYLAWILFFVLYDFCIVCITTYAINVSLMWLSFRKVQEPQGKAKRHGNTV
PGEWPWQASVRRQGAHICSGSLVADTWVLTAAHCFEKAAATELNSWSVVLGSLQREGLSPGA
EEVGVAALQLPRAYNHYSQGSDLALLQLAHPTTHTPLCLPQPAHRFPFGASCWATGWDQDTS
DAPGTLRNLRLRLISRPTCNCIYNQLHQRHLSNPARPGMLCGGPQPGVQGPCQGDSGGPVLC
LEPDGHWVQAGIISFASSCAQEDAPVLLTNTAAHSSWLQARVQGAAFLAQSPETPEMSDEDS
CVACGSLRTAGPQAGAPSPWPWEARLMHQGQLACGGALVSEEAVLTAAHCFIGRQAPEEWSV
GLGTRPEEWGLKQLILHGAYTHPEGGYDMALLLLAQPVTLGASLRPLCLPYPDHHLPDGERG
WVLGRARPGAGISSLQTVPVTLLGPRACSRLHAAPGGDGSPILPGMVCTSAVGELPSCEGLS
GAPLVHEVRGTWFLAGLHSFGDACQGPARPAVFTALPAYEDWVSSLDWQVYFAEEPEPEAEP
GSCLANISQPTSC
```

Important features:

Signal peptide:

amino acids 1-15

Homologous region to Serine proteases, trypsin family amino acids 79-95, 343-359 and 237-247

N-glycosylation sites.

amino acids 37-40 and 564-567

Kringle domains amino acids 79-96, 343-360 and 235-247

FIGURE 50

```
CGGGCCGCCCCGGCCCCCATTCGGGCCGGGCCTCGCTGCGGCGGCGACTGAGCCAGGCTGG
GCCGCGTCCCTGAGTCCCAGAGTCGGCGCGGCGCGGCAGGGGCAGCCTTCCACCACGGGGAG
CCCAGCTGTCAGCCGCCTCACAGGAGATGCTGCGTCGGCGGGGCAGCCCTGGCATGGGTGT
GCATGTGGGTGCAGCCCTGGGAGCACTGTGGTTCTGCCTCACAGGAGCCCTGGAGGTCCAGG
TCCCTGAAGACCCAGTGGTGGCACTGGTGGGCACCGATGCCACCCTGTGCTGCTCCTTCTCC
CCTGAGCCTGGCTTCAGCCTGGCACAGCTCAACCTCATCTGGCAGCTGACAGATACCAAACA
GCTGGTGCACAGCTTTGCTGAGGGCCAGGACCAGGGCAGCGCCTATGCCAACCGCACGGCCC
TCTTCCCGGACCTGCTGGCACAGGGCAACGCATCCCTGAGGCTGCAGCGCGTGCGTGTGGCG
GACGAGGGCAGCTTCACCTGCTTCGTGAGCATCCGGGATTTCGGCAGCGCTGCCGTCAGCCT
GCAGGTGGCCGCTCCCTACTCGAAGCCCAGCATGACCCTGGAGCCCAACAAGGACCTGCGGC
CAGGGGACACGGTGACCATCACGTGCTCCAGCTACCAGGGCTACCCTGAGGCTGAGGTGTTC
TGGCAGGATGGGCAGGGTGTGCCCCTGACTGGCAACGTGACCACGTCGCAGATGGCCAACGA
GCAGGGCTTGTTTGATGTGCACAGCGTCCTGCGGGTGGTGCTGGGTGCGAATGGCACCTACA
GCTGCCTGGTGCGCAACCCCGTGCTGCAGCAGGATGCGCACRGCTCTGTCACCATCACAGGG
CAGCCTATGACATTCCCCCCAGAGGCCCTGTGGGTGACCGTGGGGCTGTCTGTCTGTCTCAT
TGCACTGCTGGTGGCCCTGGCTTTCGTGTGCTGGAGAAAGATCAAACAGAGCTGTGAGGAGG
AGAATGCAGGAGCTGAGGACCAGGATGGGGAGGGAGAAGGCTCCAAGACAGCCCTGCAGCCT
CTGAAACACTCTGACAGCAAAGAAGATGATGGACAAGAAATAGCCTGACCATGAGGACCAGG
GAGCTGCTACCCCTCCCTACAGCTCCTACCCTCTGGCTGCAATGGGGCTGCACTGTGAGCCC
TGCCCCCAACAGATGCATCCTGCTCTGACAGGTGGGCTCCTTCTCCAAAGGATGCGATACAC
AGACCACTGTGCAGCCTTATTTCTCCAATGGACATGATTCCCAAGTCATCCTGCTGCCTTTT
TTCTTATAGACACAATGAACAGACCACCCACAACCTTAGTTCTCTAAGTCATCCTGCCTGCT
GCCTTATTTCACAGTACATACATTTCTTAGGGACACAGTACACTGACCACATCACCACCCTC
TTCTTCCAGTGCTGCGTGGACCATCTGGCTGCCTTTTTTCTCCAAAAGATGCAATATTCAGA
CTGACTGACCCCCTGCCTTATTTCACCAAAGACACGATGCATAGTCACCCCGGCCTTGTTTC
TCCAATGGCCGTGATACACTAGTGATCATGTTCAGCCCTGCTTCCACCTGCATAGAATCTTT
TCTTCTCAGACAGGGACAGTGCGGCCTCAACATCTCCTGGAGTCTAGAAGCTGTTTCCTTTC
CCCTCCTTCCTCCCTGCCCCAAGTGAAGACAGGGCAGGGCCAGGAATGCTTTGGGGACACCG
AGGGGACTGCCCCCACCCCCACCATGGTGCTATTCTGGGGCTGGGCAGTCTTTTCCTGGC
TTGCCTCTGGCCAGCTCCTGGCCTCTGGTAGAGTGAGACTTCAGACGTTCTGATGCCTTCCG
GATGTCATCTCTCCCTGCCCCAGGAATGGAAGATGTGAGGACTTCTAATTTAAATGTGGGAC
TCGGAGGGATTTTGTAAACTGGGGGTATATTTTGGGGAAAATAAATGTCTTTGTAAAAAAAA
AAAAAAAAAAAAAA
```

FIGURE 51

></usr/seqdb2/sst/DNA/Dnaseqs.min/ss.DNA41386
><subunit 1 of 1, 316 aa, 1 stop, 1 unknown
><MW: -1, pI: 4.62, NX(S/T): 4

MLRRRGSPGMGVHVGAALGALWFCLTGALEVQVPEDPVVALVGTDATLCCSFSPEPGFSLAQ
LNLIWQLTDTKQLVHSFAEGQDQGSAYANRTALFPDLLAQGNASLRLQRVRVADEGSFTCFV
SIRDFGSAAVSLQVAAPYSKPSMTLEPNKDLRPGDTVTITCSSYQGYPEAEVFWQDGQGVPL
TGNVTTSQMANEQGLFDVHSVLRVVLGANGTYSCLVRNPVLQQDAHXSVTITGQPMTFPPEA
LWVTVGLSVCLIALLVALAFVCWRKIKQSCEEENAGAEDQDGEGEGSKTALQPLKHSDSKED
DGQEIA

Important features:

Signal peptide:

amino acids 1-28

Transmembrane domain:

amino acids 251-270

N-glycosylation site.

amino acids 91-94, 104-107, 189-192 and 215-218

Homologous region to Immunoglobulins and MHC amino acids 217-234

FIGURE 52

```
TTCGTGACCCTTGAGAAAAGAGTTGGTGGTAAATGTGCCACGTCTTCTAAGAAGGGGAGTC
CTGAACTTGTCTGAAGCCCTTGTCCGTAAGCCTTGAACTACGTTCTTAAATCTATGAAGTCG
AGGGACCTTTCGCTGCTTTTGTAGGGACTTCTTTCCTTGCTTCAGCAACATGAGGCTTTTCT
TGTGGAACGCGGTCTTGACTCTGTTCGTCACTTCTTTGATTGGGGCTTTGATCCCTGAACCA
GAAGTGAAAATTGAAGTTCTCCAGAAGCCATTCATCTGCCATCGCAAGACCAAAGGAGGGA
TTTGATGTTGGTCCACTATGAAGGCTACTTAGAAAGGACGGCTCCTTATTTCACTCCACTC
ACAAACATAACAATGGTCAGCCCATTTGGTTTACCCTGGGCATCCTGGAGGCTCTCAAAGGT
TGGGACCAGGGCTTGAAAGGAATGTGTGTAGGAGAGAAGAGAAAGCTCATCATTCCTCCTGC
TCTGGGCTATGGAAAAGAAGGAAAAGGTAAAATTCCCCCAGAAAGTACACTGATATTTAATA
TTGATCTCCTGGAGATTCGAAATGGACCAAGATCCCATGAATCATTCCAAGAAATGGATCTT
AATGATGACTGGAAACTCTCTAAAGATGAGGTTAAAGCATATTTAAAGAAGGAGTTTGAAAA
ACATGGTGCGGTGGTGAATGAAAGTCATCATGATGCTTTGGTGGAGGATATTTTTGATAAAG
AAGATGAAGACAAAGATGGGTTTATATCTGCCAGAGAATTTACATATAAACACGATGAGTTA
TAGAGATACATCTACCCTTTTAATATAGCACTCATCTTTCAAGAGAGGGCAGTCATCTTTAA
AGAACATTTTATTTTTATACAATGTTCTTTCTTGCTTTGTTTTTTATTTTTATATATTTTTT
CTGACTCCTATTTAAAGAACCCCTTAGGTTTCTAAGTACCCATTTCTTTCTGATAAGTTATT
GGGAAGAAAAAGCTAATTGGTCTTTGAATAGAAGACTTCTGGACAATTTTTCACTTTCACAG
ATATGAAGCTTTGTTTTACTTTCTCACTTATAAATTTAAAATGTTGCAACTGGGAATATACC
ACGACATGAGACCAGGTTATAGCACAAATTAGCACCCTATATTTCTGCTTCCCTCTATTTTC
TCCAAGTTAGAGGTCAACATTTGAAAAGCCTTTTGCAATAGCCCAAGGCTTGCTATTTTCAT
GTTATAATGAAATAGTTTATGTGTAACTGGCTCTGAGTCTCTGCTTGAGGACCAGAGGAAAA
TGGTTGTTGGACCTGACTTGTTAATGGCTACTGCTTTACTAAGGAGATGTGCAATGCTGAAG
TTAGAAACAAGGTTAATAGCCAGGCATGGTGGCTCATGCCTGTAATCCCAGCACTTTGGGAG
GCTGAGGCGGGCGGATCACCTGAGGTTGGGAGTTCGAGACCAGCCTGACCAACACGGAGAAA
CCCTATCTCTACTAAAAATACAAAGTAGCCCGGCGTGGTGATGCGTGCCTGTAATCCCAGCT
ACCCAGGAAGGCTGAGGCGGCAGAATCACTTGAACCCGAGGCCGAGGTTGCGGTAAGCCGAG
ATCACCTNCAGCCTGGACACTCTGTCTCGAAAAAGAAAAGAACACGGTTAATACCATATNA
ATATGTATGCATTGAGACATGCTACCTAGGACTTAAGCTGATGAAGCTTGGCTCCTAGTGAT
TGGTGGCCTATTATGATAAATAGGACAAATCATTTATGTGTGAGTTTCTTTGTAATAAAATG
TATCAATATGTTATAGATGAGGTAGAAAGTTATATTTATATTCAATATTTACTTCTTAAGGC
TAGCGGAATATCCTTCCTGGTTCTTTAATGGGTAGTCTATAGTATATTATACTACAATAACA
TTGTATCATAAGATAAAGTAGTAAACCAGTCTACATTTTCCCATTTCTGTCTCATCAAAAAC
TGAAGTTAGCTGGGTGTGGTGGCTCATGCCTGTAATCCCAGCACTTTGGGGCCAAGGAGGG
TGGATCACTTGAGATCAGGAGTTCAAGACCAGCCTGGCCAACATGGTGAAACCTTGTCTCTA
CTAAAAATACAAAAATTAGCCAGGCGTGGTGGTGCACACCTGTAGTCCCAGCTACTCGGGAG
GCTGAGACAGGAGATTTGCTTGAACCCGGGAGGCGGAGGTTGCAGTGAGCCAAGATTGTGCC
ACTGCACTCCAGCCTGGGTGACAGAGCAAGACTCCATCTCAAAAAAAAAAAAAGAAGCAGA
CCTACAGCAGCTACTATTGAATAAATACCTATCCTGGATTTT
```

FIGURE 53

\></usr/seqdb2/sst/DNA/Dnaseqs.min/ss.DNA44194
\><subunit 1 of 1, 211 aa, 1 stop
\><MW: 24172, pI: 5.99, NX(S/T): 1

MRLFLWNAVLTLFVTSLIGALIPEPEVKIEVLQKPFICHRKTKGGDLMLVHYEGYLEKDGSL
FHSTHKHNNGQPIWFTLGILEALKGWDQGLKGMCVGEKRKLIIPPALGYGKEGKGKIPPEST
LIFNIDLLEIRNGPRSHESFQEMDLNDDWKLSKDEVKAYLKKEFEKHGAVVNESHHDALVED
IFDKEDEDKDGFISAREFTYKHDEL

Important features:

Signal peptide:
amino acids 1-20

N-glycosylation site.
amino acids 176-179

Casein kinase II phosphorylation site.
amino acids 143-146, 156-159, 178-181 and 200-203

Endoplasmic reticulum targeting sequence.
amino acids 208-211

FKBP-type peptidyl-prolyl cis-trans isomerase
amino acids 78-114 and 118-131

EF-hand calcium-binding domain.
amino acids 191-203, 184-203 and 140-159

S-100/ICaBP type calcium binding domain
amino acids 183-203

FIGURE 54

AATAAAGCTTCCTTAATGTTGTATATGTCTTTGAAGTACATCCGTGCATTTTTTTTTAGCAT
CCAACCATTCCTCCCTTGTAGTTCTCGCCCCCTCAAATCACCCTCTCCCGTAGCCCACCCGA
CTAACATCTCAGTCTCTGAAAATGCACAGAGATGCCTGGCTACCTCGCCCTGCCTTCAGCCT
CACGGGGCTCAGTCTCTTTTTCTCTTTGGTGCCACCAGGACGGAGCATGGAGGTCACAGTAC
CTGCCACCCTCAACGTCCTCAATGGCTCTGACGCCGCCTGCCCTGCACCTTCAACTCCTGC
TACACAGTGAACCACAAACAGTTCTCCCTGAACTGGACTTACCAGGAGTGCAACAACTGCTC
TGAGGAGATGTTCCTCCAGTTCCGCATGAAGATCATTAACCTGAAGCTGGAGCGGTTTCAAG
ACCGCGTGGAGTTCTCAGGGAACCCCAGCAAGTACGATGTGTCGGTGATGCTGAGAAACGTG
CAGCCGGAGGATGAGGGGATTTACAACTGCTACATCATGAACCCCCCTGACCGCCACCGTGG
CCATGGCAAGATCCATCTGCAGGTCCTCATGGAAGAGCCCCCTGAGCGGGACTCCACGGTGG
CCGTGATTGTGGGTGCCTCCGTCGGGGGCTTCCTGGCTGTGGTCATCTTGGTGCTGATGGTG
GTCAAGTGTGTGAGGAGAAAAAAAGAGCAGAAGCTGAGCACAGATGACCTGAAGACCGAGGA
GGAGGGCAAGACGGACGGTGAAGGCAACCCGGATGATGGCGCCAAGTAGTGGGTGGCCGGCC
CTGCAGCCTCCCGTGTCCCGTCTCCTCCCCTCTCCGCCCTGTACAGTGACCCTGCCTGCTCG
CTCTTGGTGTGCTTCCCGTGACCTAGGACCCCAGGGCCCACCTGGGGCCTCCTGAACCCCCG
ACTTCGTATCTCCCACCCTGCACCAAGAGTGACCCACTCTCTTCCATCCGAGAAACCTGCCA
TGCTCTGGGACGTGTGGGCCCTGGGGAGAGGAGAGAAAGGGCTCCCACCTGCCAGTCCCTGG
GGGGAGGCAGGAGGCACATGTGAGGGTCCCCAGAGAGAAGGGAGTGGGTGGGCAGGGTAGA
GGAGGGGCCGCTGTCACCTGCCCAGTGCTTGCCTGGCAGTGGCTTCAGAGAGGACCTGGTGG
GGAGGGAGGGCTTTCCTGTGCTGACAGCGCTCCCTCAGGAGGGCCTTGGCCTGGCACGGCTG
TGCTCCTCCCCTGCTCCCAGCCCAGAGCAGCCATCAGGCTGGAGGTGACGATGAGTTCCTGA
AACTTGGAGGGGCATGTTAAAGGGATGACTGTGCATTCCAGGGCACTGACGGAAAGCCAGGG
CTGCAGGCAAAGCTGGACATGTGCCCTGGCCCAGGAGGCCATGTTGGGCCCTCGTTTCCATT
GCTAGTGGCCTCCTTGGGGCTCCTGTTGGCTCCTAATCCCTTAGGACTGTGGATGAGGCCAG
ACTGGAAGAGCAGCTCCAGGTAGGGGCCATGTTTCCCAGCGGGGACCCACCAACAGAGGCC
AGTTTCAAAGTCAGCTGAGGGGCTGAGGGTGGGGCTCCATGGTGAATGCAGGTTGCTGCAG
GCTCTGCCTTCTCCATGGGGTAACCACCCTCGCCTGGGCAGGGCAGCCAAGGCTGGGAAAT
GAGGAGGCCATGCACAGGGTGGGGCAGCTTTCTTTGGGCTTCAGTGAGAACTCTCCCAGTT
GCCCTTGGTGGGGTTTCCACCTGGCTTTTGGCTACAGAGAGGGAAGGGAAAGCCTGAGGCCG
GCATAAGGGGAGGCCTTGGAACCTGAGCTGCCAATGCCAGCCCTGTCCCATCTGCGGCCACG
CTACTCGCTCCTCTCCCAACAACTCCCTTCGTGGGACAAAAGTGACAATTGTAGGCCAGGC
ACAGTGGCTCACGCCTGTAATCCCAGCACTTTGGGAGGCCAAGGCGGGTGGATTACCTCCAT
CTGTTTAGTAGAAATGGGCAAAACCCCATCTCTACTAAAAATACAAGAATTAGCTGGGCGTG
GTGGCGTGTGCCTGTAATCCCAGCTATTTGGGAGGCTGAGGCAGGAGAATCGCTTGAGCCCG
GGAAGCAGAGGTTGCAGTGAACTGAGATAGTGATAGTGCCACTGCAATTCAGCCTGGGTGAC
ATAGAGAGACTCCATCTCAAAAAAAA

FIGURE 55

</usr/seqdb2/sst/DNA/Dnaseqs.min/ss.DNA45415
<subunit 1 of 1, 215 aa, 1 stop
<MW: 24326, pI: 6.32, NX(S/T): 4
MHRDAWLPRPAFSLTGLSLFFSLVPPGRSMEVTVPATLNVLNGSDARLPCTFNSCYTVNHKQ
FSLNWTYQECNNCSEEMFLQFRMKIINLKLERFQDRVEFSGNPSKYDVSVMLRNVQPEDEGI
YNCYIMNPPDRHRGHGKIHLQVLMEEPPERDSTVAVIVGASVGGFLAVVILVLMVVKCVRRK
KEQKLSTDDLKTEEEGKTDGEGNPDDGAK

Important features:

Signal peptide:

amino acids 1-20

Transmembrane domain:

amino acids 161-179

Immunoglobulin-like fold:

amino acids 83-127

N-glycosylation sites.

amino acids 42-45, 66-69 and 74-77

FIGURE 56

GTTGTATATGTCCTGAAGTACATCCGTGCATTTTTTTAGCATCCAACCATCCTCCCTTGTA
GTTCTCGCCCCCTCAAATCACCTTCTCCCTTAGCCCACCCNACTAACATCTCAGTCTCTGAA
AATGCACAGAGATGCCTGGCTACCTCGCCCTGCCTTCAGCCTCACGGGGCTCAGTCTCTTTT
TCTCTTTGGTGCCACCAGGACGGAGCATGGAGGTCCACAGTACCTGNCCACCCTCAACGTCC
TCAATGGCTCTGACGCCCGCCTGCCCTGCCCTTCAACTCCTGCTACACAGTGAACCACAAAC
AGTTCTCCCTGAACTGGACTTACCAGGAGTGCAACAACTGCTCTGAGGAGATGTTCCTCCAG
TTCCGCATGAAGATCATTAACCTGAAGCTGGAGCGGTTTCAAGACCGCGTGGAGTTCTCAGG
GAACCCCAGCAAGTACGATGTGTCGGTGATGCTGAGAAACGTGCAGCCGGAGGATGAGGGGA
TTTACAACTGCTACATCATGAACCCCCC

FIGURE 57

TCACGGGGCTCATCTCTTTTTCTCTTTGGTGCCCACCAGGACGGAGCATGGAGGTNCACATA
CCTGCCACCCTCAACGTCCTCAATGGCTTTGACGCCCGCCTGCCCTGCACCTTCAACTCCNG
CTACACAGTGAACCACAAACAGTTCTCCCTGAACTGGATTTACCAGGAGTGCAACAACTGGC
TCTGAGGAGATGTTCCTCCAGTTCCCGCATGGAAGATCATTTAACCTGAAAGCTGGAAGCGG
TTTTCAAGAACCGCGTGGAAGTTTCTCAGGGAACCCCAGCAAGTACGATGTGTCGGTGATGC
TGAGAAACGTGCAGCCGGAGGATGAGGGGATTTACAACTGCTACATCATGAACCCCCC

FIGURE 58

```
TGCGGCGACCGTCGTACACCATGGGCCTCCACCTCCGCCCCTACCGTGTGGGGCTGCTCCCGGATGGCCTCCTGT
TCCTCTTGCTGCTGCTAATGCTGCTCGCGGACCCAGCGCTCCCGGCCGGACGTCACCCCCAGTGGTGCTGGTCC
CTGGTGATTTGGGTAACCAACTGGAAGCCAAGCTGGACAAGCCGACAGTGGTGCACTACCTCTGCTCCAAGAAGA
CCGAAAGCTACTTCACAATCTGGCTGAACCTGGAACTGCTGCTGCCTGTCATCATTGACTGCTGGATTGACAATA
TCAGGCTGGTTTACAACAAAACATCCAGGGCCACCCAGTTTCCTGATGGTGTGGATGTACGTGTCCCTGGCTTTG
GGAAGACCTTCTCACTGGAGTTCCTGGACCCCAGCAAAAGCAGCGTGGGTTCCTATTTCCACACCATGGTGGAGA
GCCTTGTGGGCTGGGGCTACACACGGGGTGAGGATGTCCGAGGGGCTCCCTATGACTGGCGCCGAGCCCAAATG
AAAACGGGCCCTACTTCCTGGCCCTCCGCGAGATGATCGAGGAGATGTACCAGCTGTATGGGGCCCCGTGGTGC
TGGTTGCCCACAGTATGGGCAACATGTACACGCTCTACTTTCTGCAGCGGCAGCCGCAGGCCTGGAAGGACAAGT
ATATCCGGGCCTTCGTGTCACTGGGTGCGCCCTGGGGGGGCGTGGCCAAGACCCTGCGCGTCCTGGCTTCAGGAG
ACAACAACCGGATCCCAGTCATCGGGCCCCTGAAGATCCGGGAGCAGCAGCGGTCAGCTGTCTCCACCAGCTGGC
TGCTGCCCTACAACTACACATGGTCACCTGAGAAGGTGTTCGTGCAGACACCCACAATCAACTACACACTGCGGG
ACTACCGCAAGTTCTTCCAGGACATCGGCTTTGAAGATGGCTGGCTCATGCGGCAGGACACAGAAGGGCTGGTGG
AAGCCACGATGCCACCTGGCGTGCAGCTGCACTGCCTCTATGGTACTGGCGTCCCCACACCAGACTCCTTCTACT
ATGAGAGCTTCCCTGACCGTGACCCTAAAATCTGCTTTGGTGACGGCGATGGTACTGTGAACTTGAAGAGTGCCC
TGCAGTGCCAGGCCTGGCAGAGCCGCCAGGAGCACCAAGTGTTGCTGCAGGAGCTGCCAGGCAGCGAGCACATCG
AGATGCTGGCCAACGCCACCACCCTGGCCTATCTGAAACGTGTGCTCCTTGGGCCCTGACTCCTGTGCCACAGGA
CTCCTGTGGCTCGGCCGTGGACCTGCTGTTGGCCTCTGGGGCTGTCATGGCCCACGCGTTTTGCAAAGTTTGTGA
CTCACCATTCAAGGCCCCGAGTCTTGGACTGTGAAGCATCTGCCATGGGGAAGTGCTGTTTGTTATCCTTTCTCT
GTGGCAGTGAAGAAGGAAGAAATGAGAGTCTAGACTCAAGGGACACTGGATGGCAAGAATGCTGCTGATGGTGGA
ACTGCTGTGACCTTAGGACTGGCTCCACAGGGTGGACTGGCTGGGCCCTGGTCCCAGTCCCTGCCTGGGCCATG
TGTCCCCCTATTCCTGTGGGCTTTTCATACTTGCCTACTGGGCCCTGGCCCCGCAGCCTTCCTATGAGGGATGTT
ACTGGGCTGTGGTCCTGTACCCAGAGGTCCCAGGGATCGGCTCCTGGCCCCTCGGGTGACCCTTCCCACACACCA
GCCACAGATAGGCCTGCCACTGGTCATGGGTAGCTAGAGCTGCTGGCTTCCCTGTGGCTTAGCTGGTGGCCAGCC
TGACTGGCTTCCTGGGCGAGCCTAGTAGCTCCTGCAGGCAGGGGCAGTTTGTTGCGTTCTTCGTGGTTCCCAGGC
CCTGGGACATCTCACTCCACTCCTACCTCCCTTACCACCAGGAGCATTCAAGCTCTGGATTGGGCAGCAGATGTG
CCCCCAGTCCCGCAGGCTGTGTTCCAGGGGCCCTGATTTCCTCGGATGTGCTATTGGCCCCAGGACTGAAGCTGC
CTCCCTTCACCCTGGGACTGTGGTTCCAAGGATGAGAGCAGGGGTTGGAGCCATGGCCTTCTGGGAACCTATGGA
GAAAGGGAATCCAAGGAAGCAGCCAAGGCTGCTCGCAGCTTCCCTGAGCTGCACCTCTTGCTAACCCCACCATCA
CACTGCCACCCTGCCCTAGGGTCTCACTAGTACCAAGTGGGTCAGCACAGGGCTGAGGATGGGGCTCCTATCCAC
CCTGGCCAGCACCCAGCTTAGTGCTGGGACTAGCCCAGAAACTTGAATGGGACCCTGAGAGAGCCAGGGTCCCC
TGAGGCCCCCTAGGGGCTTTCTGTCTGCCCCAGGGTGCTCCATGGATCTCCCTGTGGCAGCAGGCATGGAGAGT
CAGGGCTGCCTTCATGGCAGTAGGCTCTAAGTGGGTGACTGGCCACAGGCCGAGAAAAGGGTACAGCCTCTAGGT
GGGGTTCCCAAAGACGCCTTCAGGCTGGACTGAGCTGCTCTCCCACAGGGTTTCTGTGCAGCTGGATTTTCTCTG
TTGCATACATGCCTGGCATCTGTCTCCCCTTGTTCCTGAGTGGCCCCACATGGGCTCTGAGCAGGCTGTATCTG
GATTCTGGCAATAAAAGTACTCTGGATGCTGTAAAAAAAAAAAAAAAAAAAAAAA
```

FIGURE 59

>`</usr/seqdb2/sst/DNA/Dnaseqs.min/ss.DNA44189`
>`<subunit 1 of 1, 412 aa, 1 stop`
>`<MW: 46658, pI: 6.65, NX(S/T): 4`

```
MGLHLRPYRVGLLPDGLLFLLLLLMLLADPALPAGRHPPVVLVPGDLGNQLEAKLDKPTVVH
YLCSKKTESYFTIWLNLELLLPVIIDCWIDNIRLVYNKTSRATQFPDGVDVRVPGFGKTFSL
EFLDPSKSSVGSYFHTMVESLVGWGYTRGEDVRGAPYDWRRAPNENGPYFLALREMIEEMYQ
LYGGPVVLVAHSMGNMYTLYFLQRQPQAWKDKYIRAFVSLGAPWGGVAKTLRVLASGDNNRI
PVIGPLKIREQQRSAVSTSWLLPYNYTWSPEKVFVQTPTINYTLRDYRKFFQDIGFEDGWLM
RQDTEGLVEATMPPGVQLHCLYGTGVPTPDSFYYESFPDRDPKICFGDGDGTVNLKSALQCQ
AWQSRQEHQVLLQELPGSEHIEMLANATTLAYLKRVLLGP
```

Important features:

Signal peptide:

amino acids 1-28

Potential lipid substrate binding site:

amino acids 147-164

N-glycosylation sites.

amino acids 99-102, 273-276, 289-292 and 398-401

Lipases, serine proteins amino acids 189-201

Beta-transducin family Trp-Asp repeat amino acids 353-365

FIGURE 60

CGGACGCGTGGGCGGACGCGTGGGGCGGCGGCAGCGGCGGCGACGGCGACATGGAGAGCGGG
GCCTACGGCGCGGCCAAGGCGGGCGGCTCCTTCGACCTGCGGCGCTTCCTGACGCAGCCGCA
GGTGGTGGCGCGCGCCGTGTGCTTGGTCTTCGCCTTGATCGTGTTCTCCTGCATCTATGGTG
AGGGCTACAGCAATGCCCACGAGTCTAAGCAGATGTACTGCGTGTTCAACCGCAACGAGGAT
GCCTGCCGCTATGGCAGTGCCATCGGGGTGCTGGCCTTCCTGGCCTCGGCCTTCTTCTTGGT
GGTCGACGCGTATTTCCCCCAGATCAGCAACGCCACTGACCGCAAGTACCTGGTCATTGGTG
ACCTGCTCTTCTCAGCTCTCTGGACCTTCCTGTGGTTTGTTGGTTTCTGCTTCCTCACCAAC
CAGTGGGCAGTCACCAACCCGAAGGACGTGCTGGTGGGGCCGACTCTGTGAGGGCAGCCAT
CACCTTCAGCTTCTTTTCCATCTTCTCCTGGGGTGTGCTGGCCTCCCTGGCCTACCAGCGCT
ACAAGGCTGGCGTGGACGACTTCATCCAGAATTACGTTGACCCCACTCCGGACCCCAACACT
GCCTACGCCTCCTACCCAGGTGCATCTGTGGACAACTACCAACAGCCACCCTTCACCCAGAA
CGCGGAGACCACCGAGGGCTACCAGCCGCCCCTGTGTACTGAGTGGCGGTTAGCGTGGGAA
GGGGGACAGAGAGGGCCCTCCCCTCTGCCCTGGACTTTCCCATCAGCCTCCTGGAACTGCCA
GCCCCTCTCTTTCACCTGTTCCATCCTGTGCAGCTGACACACAGCTAAGGAGCCTCATAGCC
TGGCGGGGGCTGGCAGAGCCACACCCCAAGTGCCTGTGCCCAGAGGGCTTCAGTCAGCCGCT
CACTCCTCCAGGGCACTTTTAGGAAAGGGTTTTTAGCTAGTGTTTTTCCTCGCTTTTAATGA
CCTCAGCCCCGCCTGCAGTGGCTAGAAGCCAGCAGGTGCCCATGTGCTACTGACAAGTGCCT
CAGCTTCCCCCCGGCCGGGTCAGGCCGTGGGAGCCGCTATTATCTGCGTTCTCTGCCAAAG
ACTCGTGGGGCCATCACACCTGCCCTGTGCAGCGGAGCCGGACCAGGCTCTTGTGTCCTCA
CTCAGGTTTGCTTCCCCTGTGCCCACTGCTGTATGATCTGGGGCCACCACCCTGTGCCGGT
GGCCTCTGGGCTGCCTCCCGTGGTGTGAGGGCGGGGCTGGTGCTCATGGCACTTCCTCCTTG
CTCCCACCCCTGGCAGCAGGGAAGGGCTTTGCCTGACAACACCCAGCTTTATGTAAATATTC
TGCAGTTGTTACTTAGGAAGCCTGGGGAGGGCAGGGTGCCCCATGGCTCCCAGACTCTGTC
TGTGCCGAGTGTATTATAAAATCGTGGGGGAGATGCCCGGCCTGGGATGCTGTTTGGAGACG
GAATAAATGTTTTCTCATTCAAAG

FIGURE 61

</usr/seqdb2/sst/DNA/Dnaseqs.min/ss.DNA48304
<subunit 1 of 1, 224 aa, 1 stop
<MW: 24810, pI: 4.75, NX(S/T): 1
MESGAYGAAKAGGSFDLRRFLTQPQVVARAVCLVFALIVFSCIYGEGYSNAHESKQMYCVFN
RNEDACRYGSAIGVLAFLASAFFLVVDAYFPQISNATDRKYLVIGDLLFSALWTFLWFVGFC
FLTNQWAVTNPKDVLVGADSVRAAITFSFFSIFSWGVLASLAYQRYKAGVDDFIQNYVDPTP
DPNTAYASYPGASVDNYQQPPFTQNAETTEGYQPPPVY Important features:

Type II Transmembrane domain:
amino acids 1-45

Other transmembrane domains:
amino acids 74-90, 108-126 and 145-161

N-glycosylation site.
amino acids 97-100

FIGURE 62

```
GAGCCACCTACCCTGCTCCGAGGCCAGGCCTGCAGGGCCTCATCGGCCAGAGGGTGATCAGTGAGCAGAAGGATG
CCCGTGGCCGAGGCCCCCCAGGTGGCTGGCGGGCAGGGGACGGAGGTGATGGCGAGGAAGCGGAGCCAGAGGGG
ATGTTCAAGGCCTGTGAGGACTCCAAGAGAAAAGCCCGGGGCTACCTCCGCCTGGTGCCCCTGTTTGTGCTGCTG
GCCCTGCTCGTGCTGGCTTCGGCGGGGGTGCTACTCTGGTATTTCCTAGGGTACAAGGCGGAGGTGATGGTCAGC
CAGGTGTACTCAGGCAGTCTGCGTGTACTCAATCGCCACTTCTCCCAGGATCTTACCCGCCGGGAATCTAGTGCC
TTCCGCAGTGAAACCGCCAAAGCCCAGAAGATGCTCAAGGAGCTCATCACCAGCACCCGCCTGGGAACTTACTAC
AACTCCAGCTCCGTCTATTCCTTTGGGGAGGGACCCCTCACCTGCTTCTTCTGGTTCATTCTCCAAATCCCCGAG
CACCGCCGGCTGATGCTGAGCCCCGAGGTGGTGCAGGCACTGCTGGTGGAGGAGCTGCTGTCCACAGTCAACAGC
TCGGCTGCCGTCCCCTACAGGGCCGAGTACGAAGTGGACCCCGAGGGCCTAGTGATCCTGGAAGCCAGTGTGAAA
GACATAGCTGCATTGAATTCCACGCTGGGTTGTTACCGCTACAGCTACGTGGGCCAGGGCCAGGTCCTCCGGCTG
AAGGGGCCTGACCACCTGGCCTCCAGCTGCCTGTGGCACCTGCAGGGCCCCAAGGACCTCATGCTCAAACTCCGG
CTGGAGTGGACGCTGGCAGAGTGCCGGGACCGACTGGCCATGTATGACGTGGCCGGGCCCCTGGAGAAGAGGCTC
ATCACCTCGGTGTACGGCTGCAGCCGCCAGGAGCCCGTGGTGGAGGTTCTGGCGTCGGGGGCCATCATGGCGGTC
GTCTGGAAGAAGGGCCTGCACAGCTACTACGACCCCTTCGTGCTCTCCGTGCAGCCGGTGGTCTTCCAGGCCTGT
GAAGTGAACCTGACGCTGGACAACAGGCTCGACTCCCAGGGCGTCCTCAGCACCCCGTACTTCCCCAGCTACTAC
TCGCCCCAAACCCACTGCTCCTGGCACCTCACGGTGCCCTCTCTGGACTACGGCTTGGCCCTCTGGTTTGATGCC
TATGCACTGAGGAGGCAGAAGTATGATTTGCCGTGCACCCAGGGCCAGTGGACGATCCAGAACAGGAGGCTGTGT
GGCTTGCGCATCCTGCAGCCCTACGCCGAGAGGATCCCCGTGGTGGCCACGGCCGGGATCACCATCAACTTCACC
TCCCAGATCTCCCTCACCGGGCCCGGTGTGCGGGTGCACTATGGCTTGTACAACCAGTCGGACCCCTGCCCTGGA
GAGTTCCTCTGTTCTGTGAATGGACTCTGTGTCCCTGCCTGTGATGGGGTCAAGGACTGCCCCAACGGCCTGGAT
GAGAGAAACTGCGTTTGCAGAGCCACATTCCAGTGCAAAGAGGACAGCACATGCATCTCACTGCCCAAGGTCTGT
GATGGGCAGCCTGATTGTCTCAACGGCAGCGATGAAGAGCAGTGCCAGGAAGGGGTGCCATGTGGGACATTCACC
TTCCAGTGTGAGGACCGGAGCTGCGTGAAGAAGCCCAACCCGCAGTGTGATGGGCGGCCCGACTGCAGGGACGGC
TCGGATGAGGAGCACTGTGACTGTGGCCTCCAGGGCCCCTCCAGCCGCATTGTTGGTGGAGCTGTGTCCTCCGAG
GGTGAGTGGCCATGGCAGGCCAGCCTCCAGGTTCGGGGTCGACACATCTGTGGGGGGCCCTCATCGCTGACCGC
TGGGTGATAACAGCTGCCCACTGCTTCCAGGAGGACAGCATGGCCTCCACGGTGCTGTGGACCGTGTTCCTGGGC
AAGGTGTGGCAGAACTCGCGCTGGCCTGGAGAGGGTGTCCTTCAAGGTGAGCCGCCTGCTCCTGCACCCGTACCAC
GAAGAGGACAGCCATGACTACGACGTGGCGCTGCTGCAGCTCGACCACCCGGTGGTGCGCTCGGCCGCCGTGCGC
CCCGTCTGCCTGCCCGCGCGCTCCCACTTCTTCGAGCCCGGCCTGCACTGCTGGATTACGGGCTGGGGCGCCTTG
CGCGAGGGCGGCCCCATCAGCAACGCTCTGCAGAAAGTGGATGTGCAGTTGATCCCACAGGACCTGTGCAGCGAG
GCCTATCGCTACCAGGTGACGCCACGCATGCTGTGTGCCGGCTACCGCAAGGGCAAGAAGGATGCCTGTCAGGGT
GACTCAGGTGGTCCGCTGGTGTGCAAGGCACTCAGTGGCCGCTGGTTCCTGGCGGGGCTGGTCAGCTGGGGCCTG
GGCTGTGGCCGGCCTAACTACTTCGGCGTCTACACCCGCATCACAGGTGTGATCAGCTGGATCCAGCAAGTGGTG
ACCTGAGGAACTGCCCCCCTGCAAAGCAGGGCCCACCTCCTGGACTCAGAGAGCCCAGGGCAACTGCCAAGCAGG
GGGACAAGTATTCTGGCGGGGGTGGGGGAGAGAGCAGGCCCTGTGGTGGCAGGAGGTGGCATCTTGTCTCGTCC
CTGATGTCTGCTCCAGTGATGGCAGGAGGATGGAGAAGTGCCAGCAGCTGGGGGTCAAGACGTCCCCTGAGGACC
CAGGCCCACACCCAGCCCTTCTGCCTCCCAATTCTCTCTCCTCCGTCCCCTTCCTCCACTGCTGCCTAATGCAAG
GCAGTGGCTCAGCAGCAAGAATGCTGGTTCTACATCCCGAGGAGTGTCTGAGGTGCGCCCCACTCTGTACAGAGG
CTGTTTGGGCAGCCTTGCCTCCAGAGAGCAGATTCCAGCTTCGGAAGCCCCTGGTCTAACTTGGGATCTGGGAAT
GGAAGGTGCTCCCATCGGAGGGGACCCTCAGAGCCCTGGAGACTGCCAGGTGGGCCTGCTGCCACTGTAAGCCAA
AAGGTGGGGAAGTCCTGACTCCAGGGTCCTTGCCCCACCCCTGCCTGCCACCTGGGCCCTCACAGCCCAGACCCT
CACTGGGAGGTGAGCTCAGCTGCCCTTTGGAATAAAGCTGCCTGATCAAAAAAAAAAAAAAAAAAAAA
```

FIGURE 63

```
></usr/seqdb2/sst/DNA/Dnaseqs.min/ss.DNA49152
><subunit 1 of 1, 802 aa, 1 stop
><MW: 88846, pI: 6.41, NX(S/T): 7
MPVAEAPQVAGGQGDGGDGEEAEPEGMFKACEDSKRKARGYLRLVPLFVLLALLVLASAGVL
LWYFLGYKAEVMVSQVYSGSLRVLNRHFSQDLTRRESSAFRSETAKAQKMLKELITSTRLGT
YYNSSSVYSFGEGPLTCFFWFILQIPEHRRLMLSPEVVQALLVEELLSTVNSSAAVPYRAEY
EVDPEGLVILEASVKDIAALNSTLGCYRYSYVGQGQVLRLKGPDHLASSCLWHLQGPKDLML
KLRLEWTLAECRDRLAMYDVAGPLEKRLITSVYGCSRQEPVVEVLASGAIMAVVWKKGLHSY
YDPFVLSVQPVVFQACEVNLTLDNRLDSQGVLSTPYFPSYYSPQTHCSWHLTVPSLDYGLAL
WFDAYALRRQKYDLPCTQGQWTIQNRRLCGLRILQPYAERIPVVATAGITINFTSQISLTGP
GVRVHYGLYNQSDPCPGEFLCSVNGLCVPACDGVKDCPNGLDERNCVCRATFQCKEDSTCIS
LPKVCDGQPDCLNGSDEEQCQEGVPCGTFTFQCEDRSCVKKPNPQCDGRPDCRDGSDEEHCD
CGLQGPSSRIVGGAVSSEGEWPWQASLQVRGRHICGGALIADRWVITAAHCFQEDSMASTVL
WTVFLGKVWQNSRWPGEVSFKVSRLLLHPYHEEDSHDYDVALLQLDHPVVRSAAVRPVCLPA
RSHFFEPGLHCWITGWGALREGGPISNALQKVDVQLIPQDLCSEAYRYQVTPRMLCAGYRKG
KKDACQGDSGGPLVCKALSGRWFLAGLVSWGLGCGRPNYFGVYTRITGVISWIQQVVT
```

Important features:

Type II transmembrane domain:

amino acids 46-67

Serine proteases, trypsin family, histidine active site.

amino acids 604-609

N-glycosylation sites.

amino acids 127-130, 175-178, 207-210, 329-332, 424-427, 444-447 and 509-512

Kringle domains.

amino acids 746-758 and 592-609

Homologous region to Kallikrein Light Chain:

amino acids 568-779

Homologous region to Low-density lipoprotein receptor:

amino acids 451-567

FIGURE 64

GCACCCAGGGCCAGTGGACGATCCAGAACAGGAGGCTGTGTGGCTTGCGCATCCTGCAGCCC
TACGCCGAGAGGATCCCCGTGGTGGCCACGGCCGGGATCACCATCAACTTCACCTCCCAGAT
CTCCCTCACCGGGCCCGGTGTGCGGGTGCACTATGGCTTGTACAACCAGTCGGACCCCTGCC
CTGGAGAGTTCCTCTGTTCTGTGAATGGACTCTGTGTCCCTGCCTGTGATGGGGTCAAGGAC
TGCCCCAACGGCCTGGATGAGAGAAACTGCGTTTGCAGAGCCACATTCCAGTGCAAAGAGGA
CAGCACATGCATCTCACTGCCCAAGGTCTGTGATGGGCAGCCTGATTGTCTCAACGGCAGCG
ATGAAGAGCAGTGCCAGGAAGGGGTGCCATGTGGGACATTCACCTTCCAGTGTGAGGACCGG
AGCTGCGTGAAGAAGCCCAACCCGCAGTGTGATGGGCGGCCCGACTGCAGGGACGGCTCGGA
TGAGGAGCACTGTGACTGTGGCCTCCAGGGCCCCTCCAGCCGCATTGTTGGTGGAGCTGTGT
CCTCCGAGGGTGAGTGGCCATGGCAGGCCAGCCTCCAGGTTCGGGGTCGACACATCTGTGGG
GGGGCCCTCATCGCTGACCGCTGGGTGATAACAGCTGCCCACTGCTTCCAGGAGGACAGCAT
GGCCTCCACGGTGCTGTGGACCGTGTTCCTGGGCAAGGTGTGGCAGAACTCGCGCTGGCCTG
GAGAGGTGTCCTTCAAGGTGAGCCGCCTGCTCCTGCACCCGTACCACGAAGAGGACAGCCAT
GACTACGACGTGGCGCTGCTGCAGCTCGACCACCCGGTGGTGCGCTCGGCCGCCGTGCGCCC
CGTCTGCCTGCCCGCGCGCTCCCACTTCTTCGAGCCCGGCCTGCACTGCTGGATTACGGGCT
GGGGCGCCTTGCGCGAGGGCGGCCCCATCAGCAACGCTCTGCAGAAAGTGGATGTGCAGTTG
ATCCCACAGGACCTGTGCAGCGAGGCCTATCGCTACCAGGTGACGCCACGCATGCTGTGTGC
CGGCTACCGCAAGGGCAAGAAGGATGCCTGTCAGGGTGACTCAGGTGGTCCGCTGGTGTGCA
AGGCACTCAGTGGCCGCTGGTTCCTGGCGGGGCTGGTCAGCTGGGGCCTGGGCTGTGGCCGG
CCTAACTACTTCGGCGTCTACACCCGCATCACAGGTGTGATCAGCTGGATCCAGCAAGTGGT
GACCTGAGGAACTGCCCCCCTGCAAAGCAGGGCCCACCTCCTGGACTCAGAGAGCCCAGGGC
AACTGCCAAGCAGGGGGACAAGTAT

FIGURE 65

GGACGAGGGCAGATCTCGTTCTGGGGCAAGCCGTTGACACTCGCTCCCTGCCACCGCCCGGG
CTCCGTGCCGCCAAGTTTTCATTTTCCACCTTCTCTGCCTCCAGTCCCCCAGCCCCTGGCCG
AGAGAAGGGTCTTACCGGCCGGGATTGCTGGAAACACCAAGAGGTGGTTTTTGTTTTTTAAA
ACTTCTGTTTCTTGGGAGGGGGTGTGGCGGGGCAGGATGAGCAACTCCGTTCCTCTGCTCTG
TTTCTGGAGCCTCTGCTATTGCTTTGCTGCGGGAGCCCCGTACCTTTTGGTCCAGAGGGAC
GGCTGGAAGATAAGCTCCACAAACCCAAAGCTACACAGACTGAGGTCAAACCATCTGTGAGG
TTTAACCTCCGCACCTCCAAGGACCCAGAGCATGAAGGATGCTACCTCTCCGTCGGCCACAG
CCAGCCCTTAGAAGACTGCAGTTTCAACATGACAGCTAAAACCTTTTTCATCATTCACGGAT
GGACGATGAGCGGTATCTTTGAAAACTGGCTGCACAAACTCGTGTCAGCCCTGCACACAAGA
GAGAAGACGCCAATGTAGTTGTGGTTGACTGGCTCCCCCTGGCCCACCAGCTTTACACGGA
TGCGGTCAATAATACCAGGGTGGTGGGACACAGCATTGCCAGGATGCTCGACTGGCTGCAGG
AGAAGGACGATTTTTCTCTCGGGAATGTCCACTTGATCGGCTACAGCCTCGGAGCGCACGTG
GCCGGGTATGCAGGCAACTTCGTGAAAGGAACGGTGGGCCGAATCACAGGTTTGGATCCTGC
CGGGCCCATGTTTGAAGGGGCCGACATCCACAAGAGGCTCTCTCCGGACGATGCAGATTTTG
TGGATGTCCTCCACACCTACACGCGTTCCTTCGGCTTGAGCATTGGTATTCAGATGCCTGTG
GGCCACATTGACATCTACCCCAATGGGGGTGACTTCCAGCCAGGCTGTGGACTCAACGATGT
CTTGGGATCAATTGCATATGGAACAATCACAGAGGTGGTAAAATGTGAGCATGAGCGAGCCG
TCCACCTCTTTGTTGACTCTCTGGTGAATCAGGACAAGCCGAGTTTTGCCTTCCAGTGCACT
GACTCCAATCGCTTCAAAAAGGGGATCTGTCTGAGCTGCCGCAAGAACCGTTGTAATAGCAT
TGGCTACAATGCCAAGAAAATGAGGAACAAGAGGAACAGCAAAATGTACCTAAAAACCCGGG
CAGGCATGCCTTTCAGAGGTAACCTTCAGTCCCTGGAGTGTCCCTGAGGAAGGCCCTTAATA
CCTCCTTCTTAATACCATGCTGCAGAGCAGGGCACATCCTAGCCCAGGAGAAGTGGCCAGCA
CAATCCAATCAAATCGTTGCAAATCAGATTACACTGTGCATGTCCTAGGAAAGGGAATCTTT
ACAAAATAAACAGTGTGGACCCCTAATAAAAAAAAAAAAAAAAAAAAAAAAAAAAAAAAAAA
AAAAAAAAAAAAAAAAAAAAA

FIGURE 66

></usr/seqdb2/sst/DNA/Dnaseqs.min/ss.DNA49646
><subunit 1 of 1, 354 aa, 1 stop
><MW: 39362, pI: 8.35, NX(S/T): 2
MSNSVPLLCFWSLCYCFAAGSPVPFGPEGRLEDKLHKPKATQTEVKPSVRFNLRTSKDPEHE
GCYLSVGHSQPLEDCSFNMTAKTFFIIHGWTMSGIFENWLHKLVSALHTREKDANVVVVDWL
PLAHQLYTDAVNNTRVVGHSIARMLDWLQEKDDFSLGNVHLIGYSLGAHVAGYAGNFVKGTV
GRITGLDPAGPMFEGADIHKRLSPDDADFVDVLHTYTRSFGLSIGIQMPVGHIDIYPNGGDF
QPGCGLNDVLGSIAYGTITEVVKCEHERAVHLFVDSLVNQDKPSFAFQCTDSNRFKKGICLS
CRKNRCNSIGYNAKKMRNKRNSKMYLKTRAGMPFRGNLQSLECP Important features:
Signal peptide:
amino acids 1-16

Lipases, serine active site.
amino acids 163-172

N-glycosylation sites.
amino acids 80-83 and 136-139

FIGURE 67

```
CGGACGCGTGGGCGGACGCGTGGGCCTGGGCAAGGGCCGGGGCGCCGGGCCGAGCCACCTCTTCCCCTCCCCGC
TTCCCTGTCGCGCTCCGCTGGCTGGACGCGCTGGAGGAGTGGAGCAGCACCCGGCCGGCCCTGGGGGCTGACAGT
CGGCAAAGTTTGGCCCGAAGAGGAAGTGGTCTCAAACCCCGGCAGGTGGCGACCAGGCCAGACCAGGGGCGCTCG
CTGCCTGCGGGCGGGCTGTAGGCGAGGGCGCGCCCCAGTGCCGAGACCCGGGGCTTCAGGAGCCGGCCCCGGGAG
AGAAGAGTGCGGCGGCGGACGGAGAAAACAACTCCAAAGTTGGCGAAAGGCACCGCCCCTACTCCCGGGCTGCCG
CCGCCTCCCCGCCCCCAGCCCTGGCATCCAGAGTACGGGTCGAGCCCGGGCCATGGAGCCCCCTGGGGAGGCGG
CACCAGGGAGCCTGGGCGCCGGGGCTCCGCCGCGACCCCATCGGGTAGACCACAGAAGCTCCGGGACCCTTCCG
GCACCTCTGGACAGCCCAGGATGCTGTTGGCCACCCTCCTCCTCCTCCTCCTTGGAGGCGCTCTGGCCCATCCAG
ACCGGATTATTTTTCCAAATCATGCTTGTGAGGACCCCCAGCAGTGCTCTTAGAAGTGCAGGGCACCTTACAGA
GGCCCCTGGTCCGGGACAGCCGCACCTCCCCTGCCAACTGCACCTGGCTCATCCTGGGCAGCAAGGAACAGACTG
TCACCATCAGGTTCCAGAAGCTACACCTGGCCTGTGGCTCAGAGCGCTTAACCCTACGCTCCCCTCTCCAGCCAC
TGATCTCCCTGTGTGAGGCACCTCCCAGCCCTCTGCAGCTGCCCGGGGGCAACGTCACCATCACTTACAGCTATG
CTGGGGCCAGAGCACCCATGGGCCAGGGCTTCCTGCTCTCCTACAGCCAAGATTGGCTGATGTGCCTGCAGGAAG
AGTTTCAGTGCCTGAACCACCGCTGTGTATCTGCTGTCCAGCGCTGTGATGGGGTTGATGCCTGTGGCGATGGCT
CTGATGAAGCAGGTTGCAGCTCAGACCCCTTCCCTGGCCTGACCCCAAGACCCGTCCCCTCCCTGCCTTGCAATG
TCACCTTGGAGGACTTCTATGGGGTCTTCTCCTCTCCTGGATATACACACCTAGCCTCAGTCTCCCACCCCCAGT
CCTGCCATTGGCTGCTGGACCCCCATGATGGCCGGCGGCTGGCCGTGCGCTTCACAGCCCTGGACTTGGGCTTTG
GAGATGCAGTGCATGTGTATGACGGCCCTGGGCCCCTGAGAGCTCCCGACTACTGCGTAGTCTCACCCACTTCA
GCAATGGCAAGGCTGTCACTGTGGAGACACTGTCTGGCCAGGCTGTTGTGTCCTACCACACAGTTGCTTGGAGCA
ATGGTCGTGGCTTCAATGCCACCTACCATGTGCGGGCTATTGCTTGCCTTGGGACAGACCCTGTGGCTTAGGCT
CTGGCCTGGGAGCTGGCGAAGGCCTAGGTGAGCGCTGCTACAGTGAGGCACAGCGCTGTGACGGCTCATGGGACT
GTGCTGACGGCACAGATGAGGAGGACTGCCCAGGCTGCCCACCTGGACACTTCCCCTGTGGGGCTGCTGGCACCT
CTGGTGCCACAGCCTGCTACCTGCCTGCTGACCGCTGCAACTACCAGACTTTCTGTGCTGATGGAGCAGATGAGA
GACGCTGTCGGCATTGCCAGCCTGGCAATTTCCGATGCCGGGACGAGAAGTGCGTGTATGAGACGTGGGTGTGCG
ATGGGCAGCCAGACTGTGCGGACGGCAGTGATGAGTGGGACTGCTCCTATGTTCTGCCCCGCAAGGTCATTACAG
CTGCAGTCATTGGCAGCCTAGTGTGCGGCCTGCTCCTGGTCATCGCCCTGGGCTGCACCTGCAAGCTCTATGCCA
TTCGCACCCAGGAGTACAGCATCTTTGCCCCCCTCTCCCGGATGGAGGCTGAGATTGTGCAGCAGCAGGCACCCC
CTTCCTACGGGCAGCTCATTGCCCAGGGTGCCATCCCACCTGTAGAAGACTTTCCTACAGAGAATCCTAATGATA
ACTCAGTGCTGGGCAACCTGCGTTCTCTGCTACAGATCTTACGCCAGGATATGACTCCAGGAGGTGGCCCAGGTG
CCCGCCGTCGTCAGCGGGGCCGCTTGATGCGACGCCTGGTACGCCGTCTCCGCCGCTGGGGCTTGCTCCCTCGAA
CCAACACCCCGGCTCGGGCGTCCTGAGGCCAGATCCCAGGTCACACCTTCTGCTGCTCCCCTTGAGGCCCTAGATG
GTGGCACAGGTCCAGCCCGTGAGGGCGGGGCAGTGGGTGGGCAAGATGGGGAGCAGGCACCCCCACTGCCCATCA
AGGCTCCCCTCCCATCTGCTAGCACGTCTCCAGCCCCACTACTGTCCCTGAAGCCCCAGGGCCACTGCCCTCAC
TGCCCCTAGAGCCATCACTATTGTCTGGAGTGGTGCAGGCCCTGCGAGGCCGCCTGTTGCCCAGCCTGGGGCCCC
CAGGACCAACCCGGAGCCCCCCTGGACCCCACACAGCAGTCCTGGCCCTGGAAGATGAGGACGATGTGCTACTGG
TGCCACTGGCTGAGCCGGGGTGTGGGTAGCTGAGGCAGAGGATGAGCCACTGCTTACCTGAGGGGACCTGGGGG
CTCTACTGAGGCCTCTCCCCTGGGGGCTCTACTCATAGTGGCACAACCTTTTAGAGGTGGGTCAGCCTCCCCTCC
ACCACTTCCTTCCCTGTCCCTGGATTTCAGGGACTTGGTGGGCCTCCCGTTGACCCTATGTAGCTGCTATAAAGT
TAAGTGTCCCTCAGGCAGGGAGAGGGCTCACAGAGTCTCCTCTGTACGTGGCCATGGCCAGACACCCCAGTCCCT
TCACCACCACCTGCTCCCACGCCACCACCATTTGGGTGGCTGTTTTTAAAAAGTAAAGTTCTTAGAGGATCATA
GGTCTGGACACTCCATCCTTGCCAAACCTCTACCCAAAAGTGGCCTTAAGCACCGGAATGCCAATTAACTAGAGA
CCCTCCAGCCCCAAGGGGAGGATTTGGGCAGAACCTGAGGTTTTGCCATCCACAATCCCTCCTACAGGGCCTGG
CTCACAAAAAGAGTGCAACAAATGCTTCTATTCCATAGCTACGGCATTGCTCAGTAAGTTGAGGTCAAAAATAAA
GGAATCATACATCTC
```

FIGURE 68

```
</usr/seqdb2/sst/DNA/Dnaseqs.min/ss.DNA49631
<subunit 1 of 1, 713 aa, 1 stop
<MW: 76193, pI: 5.42, NX(S/T): 4
```

MLLATLLLLLLGGALAHPDRIIFPNHACEDPPAVLLEVQGTLQRPLVRDSRTSPANCTWLIL
GSKEQTVTIRFQKLHLACGSERLTLRSPLQPLISLCEAPPSPLQLPGGNVTITYSYAGARAP
MGQGFLLSYSQDWLMCLQEEFQCLNHRCVSAVQRCDGVDACGDGSDEAGCSSDPFPGLTPRP
VPSLPCNVTLEDFYGVFSSPGYTHLASVSHPQSCHWLLDPHDGRRLAVRFTALDLGFGDAVH
VYDGPGPPESSRLLRSLTHFSNGKAVTVETLSGQAVVSYHTVAWSNGRGFNATYHVRGYCLP
WDRPCGLGSGLGAGEGLGERCYSEAQRCDGSWDCADGTDEEDCPGCPPGHFPCGAAGTSGAT
ACYLPADRCNYQTFCADGADERRCRHCQPGNFRCRDEKCVYETWVCDGQPDCADGSDEWDCS
YVLPRKVITAAVIGSLVCGLLLVIALGCTCKLYAIRTQEYSIFAPLSRMEAEIVQQQAPPSY
GQLIAQGAIPPVEDFPTENPNDNSVLGNLRSLLQILRQDMTPGGGPGARRRQRGRLMRRLVR
RLRRWGLLPRTNTPARASEARSQVTPSAAPLEALDGGTGPAREGGAVGGQDGEQAPPLPIKA
PLPSASTSPAPTTVPEAPGPLPSLPLEPSLLSGVVQALRGRLLPSLGPPGPTRSPPGPHTAV
LALEDEDDVLLVPLAEPGVWVAEAEDEPLLT

Important features:

Signal peptide:
amino acids 1-16

Transmembrane domain:
amino acids 442-462

LDL-receptor class A (LDLRA) domain proteins
amino acids 411-431, 152-171, 331-350 and 374-393

FIGURE 69

CGAGCTGGGCGAGAAGTAGGGGAGGGCGGTGCTCCGCCGCGGTGGCGGTTGCTATCGCTTCG
CAGAACCTACTCAGGCAGCCAGCTGAGAAGAGTTGAGGGAAAGTGCTGCTGCTGGGTCTGCA
GACGCGATGGATAACGTGCAGCCGAAAATAAAACATCGCCCCTTCTGCTTCAGTGTGAAAGG
CCACGTGAAGATGCTGCGGCTGGCACTAACTGTGACATCTATGACCTTTTTTATCATCGCAC
AAGCCCCTGAACCATATATTGTTATCACTGGATTTGAAGTCACCGTTATCTTATTTTTCATA
CTTTTATATGTACTCAGACTTGATCGATTAATGAAGTGGTTATTTTGGCCTTTGCTTGATAT
TATCAACTCACTGGTAACAACAGTATTCATGCTCATCGTATCTGTGTTGGCACTGATACCAG
AAACCACAACATTGACAGTTGGTGGAGGGGTGTTTGCACTTGTGACAGCAGTATGCTGTCTT
GCCGACGGGGCCCTTATTTACCGGAAGCTTCTGTTCAATCCCAGCGGTCCTTACCAGAAAAA
GCCTGTGCATGAAAAAAAGAAGTTTTGTAATTTTATATTACTTTTTAGTTTGATACTAAGT
ATTAAACATATTTCTGTATTCTTCCAAAAAAAAAAAAAAAAAA

FIGURE 70

```
></usr/seqdb2/sst/DNA/Dnaseqs.min/ss.DNA49645
><subunit 1 of 1, 152 aa, 1 stop
><MW: 17170, pI: 9.62, NX(S/T): 1
MDNVQPKIKHRPFCFSVKGHVKMLRLALTVTSMTFFIIAQAPEPYIVITGFEVTVILFFILL
YVLRLDRLMKWLFWPLLDIINSLVTTVFMLIVSVLALIPETTTLTVGGGVFALVTAVCCLAD
GALIYRKLLFNPSGPYQKKPVHEKKEVL
```

Important features:

Potential type II transmembrane domain:

amino acids 26-42

Other potential transmembrane domain:

amino acids 44-65, 81-101 and 109-129

Leucine zipper pattern amino acids 78-99 and 85-106

N-myristoylation site.

amino acids 110-115

Ribonucleotide reductase large subunit protein amino acids 116-127

FIGURE 71

GGGCGAGAAGTAGGGGAGGGCGTGTTCCGCCGCGGTGGCGGTTGCTATCGTTTTGCAGAACC

TACTCAGGCAGCCAGNTGAGAAGAGTTGAGGGAAAGTGCTGCTGCTGGGTCTGCAGACGCGA

TGGATAACGTGCAGCCGAAAATAAAACATCGCCCCTTCTGCTTCAGTGTGAAAGGCCACGTG

AAGATGCTGCGGCTGGCACTAACTGNGACATCTATGACCTTTTTTATNATCGCACAAGCCCC

TGAACCATATATTGTTATCACTGGATTTGAAGTCACCGTTATCTTATTTTTCATACTTTTAT

ATGTACTCAGACTTGATCGATTAATGAAGTGGTTATTTTGGCCTTTGCTTGATATTATCAAC

TCACTGGTAACAACAGTATTCATGCTCATCGTATCTGTGTTGGCACTGATACCAGAAACCAC

AACATTGACAGTTGGTGGAGGGGTGTTTGCACTTGTGACAGCAGTATGCTGTNTTGCCGAC

FIGURE 72

CAGCCCCGCGCGCCGGCCGAGTCGCTGAGCCGCGGCTGCCGGACGGGACGGGACCGGCTAGG
CTGGGCGCGCCCCCGGGCCCCGCCGTGGGATGGGCGCACTGGCCCGGGCGCTGCTGCTGC
CTCTGCTGGCCCAGTGGCTCCTGCGCGCCGCCCCGGAGCTGGCCCCGCGCCCTTCACGCTG
CCCCTCCGGGTGGCCGCGGCCACGAACCGCGTAGTTGCGCCCACCCCGGGACCCGGGACCCC
TGCCGAGCGCCACGCCGACGGCTTGGCGCTCGCCCTGGAGCCTGCCCTGGCGTCCCCGCGG
GCGCCGCCAACTTCTTGGCCATGGTAGACAACCTGCAGGGGACTCTGGCCGCGGCTACTAC
CTGGAGATGCTGATCGGGACCCCCCGCAGAAGCTACAGATTCTCGTTGACACTGGAAGCAG
TAACTTTGCCGTGGCAGGAACCCCGCACTCCTACATAGACACGTACTTTGACACAGAGAGGT
CTAGCACATACCGCTCCAAGGGCTTTGACGTCACAGTGAAGTACACACAAGGAAGCTGGACG
GGCTTCGTTGGGGAAGACCTCGTCACCATCCCCAAAGGCTTCAATACTTCTTTTCTTGTCAA
CATTGCCACTATTTTTGAATCAGAGAATTTCTTTTTGCCTGGGATTAAATGGAATGGAATAC
TTGGCCTAGCTTATGCCACACTTGCCAAGCCATCAAGTTCTCTGGAGACCTTCTTCGACTCC
CTGGTGACACAAGCAAACATCCCCAACGTTTTCTCCATGCAGATGTGTGGAGCCGGCTTGCC
CGTTGCTGGATCTGGGACCAACGGAGGTAGTCTTGTCTTGGGTGGAATTGAACCAAGTTTGT
ATAAAGGAGACATCTGGTATACCCCTATTAAGGAAGAGTGGTACTACCAGATAGAAATTCTG
AAATTGGAAATTGGAGGCCAAAGCCTTAATCTGGACTGCAGAGAGTATAACGCAGACAAGGC
CATCGTGGACAGTGGCACCACGCTGCTGCGCCTGCCCCAGAAGGTGTTTGATGCGGTGGTGG
AAGCTGTGGCCCGCGCATCTCTGATTCCAGAATTCTCTGATGGTTTCTGGACTGGGTCCCAG
CTGGCGTGCTGGACGAATTCGGAAACACCTTGGTCTTACTTCCCTAAAATCTCCATCTACCT
GAGAGACGAGAACTCCAGCAGGTCATTCCGTATCACAATCCTGCCTCAGCTTTACATTCAGC
CCATGATGGGGGCCGGCCTGAATTATGAATGTTACCGATTCGGCATTTCCCCATCCACAAAT
GCGCTGGTGATCGGTGCCACGGTGATGGAGGGCTTCTACGTCATCTTCGACAGAGCCCAGAA
GAGGGTGGGCTTCGCAGCGAGCCCCTGTGCAGAAATTGCAGGTGCTGCAGTGTCTGAAATTT
CCGGGCCTTTCTAACAGAGGATGTAGCCAGCAACTGTGTCCCCGCTCAGTCTTTGAGCGAG
CCCATTTTGTGGATTGTGTCCTATGCGCTCATGAGCGTCTGTGGAGCCATCCTCCTTGTCTT
AATCGTCCTGCTGCTGCTGCCGTTCCGGTGTCAGCGTCGCCCCGTGACCCTGAGGTCGTCA
ATGATGAGTCCTCTCTGGTCAGACATCGCTGGAAATGAATAGCCAGGCCTGACCTCAAGCAA
CCATGAACTCAGCTATTAAGAAAATCACATTTCCAGGGCAGCAGCCGGGATCGATGGTGGCG
CTTTCTCCTGTGCCCACCCGTCTTCAATCTCTGTTCTGCTCCCAGATGCCTTCTAGATTCAC
TGTCTTTTGATTCTTGATTTTCAAGCTTTCAAATCCTCCCTACTTCCAAGAAAAATAATTAA
AAAAAAAACTTCATTCTAA

FIGURE 73

></usr/seqdb2/sst/DNA/Dnaseqs.min/ss.DNA45493
><subunit 1 of 1, 518 aa, 1 stop
><MW: 56180, pI: 5.08, NX(S/T): 2

MGALARALLLPLLAQWLLRAAPELAPAPFTLPLRVAAATNRVVAPTPGPGTPAERHADGLAL
ALEPALASPAGAANFLAMVDNLQGDSGRGYYLEMLIGTPPQKLQILVDTGSSNFAVAGTPHS
YIDTYFDTERSSTYRSKGFDVTVKYTQGSWTGFVGEDLVTIPKGFNTSFLVNIATIFESENF
FLPGIKWNGILGLAYATLAKPSSSLETFFDSLVTQANIPNVFSMQMCGAGLPVAGSGTNGGS
LVLGGIEPSLYKGDIWYTPIKEEWYYQIEILKLEIGGQSLNLDCREYNADKAIVDSGTTLLR
LPQKVFDAVVEAVARASLIPEFSDGFWTGSQLACWTNSETPWSYFPKISIYLRDENSSRSFR
ITILPQLYIQPMMGAGLNYECYRFGISPSTNALVIGATVMEGFYVIFDRAQKRVGFAASPCA
EIAGAAVSEISGPFSTEDVASNCVPAQSLSEPILWIVSYALMSVCGAILLVLIVLLLPFRC
QRRPRDPEVVNDESSLVRHRWK

Important features:

Signal peptide:

amino acids 1-20

Transmembrane domain:

amino acids 466-494

N-glycosylation sites.

amino acids 170-173 and 366-369

Leucine zipper pattern.

amino acids 10-31 and 197-118

Eukaryotic and viral aspartyl proteases amino acids 109-118, 252-261 and 298-310

FIGURE 74

CGCCTCCGCCTTCGGAGGCTGACGCGCCCGGGCGCCGTTCCAGGCCTGTGCAGGGCGGATCG
GCAGCCGCCTGGCGGCGATCCAGGGCGGTGCGGGGCCTGGGCGGGAGCCGGGAGGCGCGGCC
GGCATGGAGGCGCTGCTGCTGGGCGCGGGGTTGCTGCTGGGCGCTTACGTGCTTGTCTACTA
CAACCTGGTGAAGGCCCCGCCGTGCGGCGGCATGGGCAACCTGCGGGCCGCACGGCCGTGG
TCACGGGCGCCAACAGCGGCATCGGAAAGATGACGGCGCTGGAGCTGGCGCGCCGGGGAGCG
CGCGTGGTGCTGGCCTGCCGCAGCCAGGAGCGCGGGGAGGCGGCTGCCTTCGACCTCCGCCA
GGAGAGTGGGAACAATGAGGTCATCTTCATGGCCTTGGACTTGGCCAGTCTGGCCTCGGTGC
GGGCCTTTGCCACTGCCTTTCTGAGCTCTGAGCCACGGTTGGACATCCTCATCCACAATGCC
GGTATCAGTTCCTGTGGCCGGACCCGTGAGGCGTTTAACCTGCTGCTTCGGGTGAACCATAT
CGGTCCCTTTCTGCTGACACATCTGCTGCTGCCTTGCCTGAAGGCATGTGCCCTAGCCGCG
TGGTGGTGGTAGCCTCAGCTGCCCACTGTCGGGGACGTCTTGACTTCAAACGCCTGGACCGC
CCAGTGGTGGGCTGGCGGCAGGAGCTGCGGGCATATGCTGACACTAAGCTGGCTAATGTACT
GTTTGCCCGGGAGCTCGCCAACCAGCTTGAGGCCACTGGCGTCACCTGCTATGCAGCCCACC
CAGGGCCTGTGAACTCGGAGCTGTTCCTGCGCCATGTTCCTGGATGGCTGCGCCCACTTTTG
CGCCCATTGGCTTGGCTGGTGCTCCGGGCACCAAGAGGGGGTGCCCAGACACCCCTGTATTG
TGCTCTACAAGAGGGCATCGAGCCCCTCAGTGGGAGATATTTTGCCAACTGCCATGTGGAAG
AGGTGCCTCCAGCTGCCCGAGACGACCGGGCAGCCCATCGGCTATGGGAGGCCAGCAAGAGG
CTGGCAGGGCTTGGGCCTGGGGAGGATGCTGAACCCGATGAAGACCCCAGTCTGAGGACTC
AGAGGCCCCATCTTCTCTAAGCACCCCCACCCTGAGGAGCCCACAGTTTCTCAACCTTACC
CCAGCCCTCAGAGCTCACCAGATTTGTCTAAGATGACGCACCGAATTCAGGCTAAAGTTGAG
CCTGAGATCCAGCTCTCCTAACCCTCAGGCCAGGATGCTTGCCATGGCACTTCATGGTCCTT
GAAAACCTCGGATGTGTGTGAGGCCATGCCCTGGACACTGACGGGTTTGTGATCTTGACCTC
CGTGGTTACTTTCTGGGGCCCCAAGCTGTGCCCTGGACATCTCTTTTCCTGGTTGAAGGAAT
AATGGGTGATTATTTCTTCCTGAGAGTGACAGTAACCCCAGATGGAGAGATAGGGGTATGCT
AGACACTGTGCTTCTCGGAAATTTGGATGTAGTATTTTCAGGCCCCACCCTTATTGATTCTG
ATCAGCTCTGGAGCAGAGGCAGGGAGTTTGCAATGTGATGCACTGCCAACATTGAGAATTAG
TGAACTGATCCCTTTGCAACCGTCTAGCTAGGTAGTTAAATTACCCCCATGTTAATGAAGCG
GAATTAGGCTCCCGAGCTAAGGGACTCGCCTAGGGTCTCACAGTGAGTAGGAGGAGGGCCTG
GGATCTGAACCCAAGGGTCTGAGGCCAGGGCCGACTGCCGTAAGATGGGTGCTGAGAAGTGA
GTCAGGGCAGGGCAGCTGGTATCGAGGTGCCCCATGGGAGTAAGGGGACGCCTTCCGGGCGG
ATGCAGGGCTGGGGTCATCTGTATCTGAAGCCCCTCGGAATAAAGCGCGTTGACCGCCAAAA
AAAAAAAAAAAAAAAAA

FIGURE 75

</usr/seqdb2/sst/DNA/Dnaseqs.min/ss.DNA48227
<subunit 1 of 1, 377 aa, 1 stop
<MW: 40849, pI: 7.98, NX(S/T): 0

MEALLLGAGLLLGAYVLVYYNLVKAPPCGGMGNLRGRTAVVTGANSGIGKMTALELARRGAR
VVLACRSQERGEAAAFDLRQESGNNEVIFMALDLASLASVRAFATAFLSSEPRLDILIHNAG
ISSCGRTREAFNLLLRVNHIGPFLLTHLLLPCLKACAPSRVVVVASAAHCRGRLDFKRLDRP
VVGWRQELRAYADTKLANVLFARELANQLEATGVTCYAAHPGPVNSELFLRHVPGWLRPLLR
PLAWLVLRAPRGGAQTPLYCALQEGIEPLSGRYFANCHVEEVPPAARDDRAAHRLWEASKRL
AGLGPGEDAEPDEDPQSEDSEAPSSLSTPHPEEPTVSQPYPSPQSSPDLSKMTHRIQAKVEP
EIQLS

Important features:
Signal peptide:
amino acids 1-16

Glycosaminoglycan attachment site.
amino acids 46-49

Short-chain alcohol dehydrogenase family
amino acids 37-49 and 114-124

FIGURE 76

```
GGAGGAGACAGCCTCCTGGGGGGCAGGGGTTCCCTGCCTCTGCTGCTCCTGCTCATCATGGGAGGCATGGCTCAG
GACTCCCCGCCCCAGATCCTAGTCCACCCCCAGGACCAGCTGTTCCAGGGCCCTGGCCCTGCCAGGATGAGCTGC
CAAGCCTCAGGCCAGCCACCTCCCACCATCCGCTGGTTGCTGAATGGGCAGCCCCTGAGCATGGTGCCCCCAGAC
CCACACCACCTCCTGCCTGATGGGACCCTTCTGCTGCTACAGCCCCCTGCCCGGGGACATGCCCACGATGGCCAG
GCCCTGTCCACAGACCTGGGTGTCTACACATGTGAGGCCAGCAACCGGCTTGGCACGGCAGTCAGCAGAGGCGCT
CGGCTGTCTGTGGCTGTCCTCCGGGAGGATTTCCAGATCCAGCCTCGGGACATGGTGGCTGTGGTGGGTGAGCAG
TTTACTCTGGAATGTGGGCCGCCCTGGGGCCACCCAGAGCCCACAGTCTCATGGTGGAAAGATGGGAAACCCCTG
GCCCTCCAGCCCGGAAGGCACACAGTGTCCGGGGGTCCCTGCTGATGGCAAGAGCAGAGAAGAGTGACGAAGGG
ACCTACATGTGTGTGGCCACCAACAGCGCAGGACATAGGGAGAGCCGCGCAGCCCGGGTTTCCATCCAGGAGCCC
CAGGACTACACGGAGCCTGTGGAGCTTCTGGCTGTGCGAATTCAGCTGGAAAATGTGACACTGCTGAACCCGGAT
CCTGCAGAGGGCCCCAAGCCTAGACCGGCGGTGTGGCTCAGCTGGAAGGTCAGTGGCCCTGCTGCGCCTGCCCAA
TCTTACACGGCCTTGTTCAGGACCCAGACTGCCCCGGGAGGCCAGGGAGCTCCGTGGGCAGAGGAGCTGCTGGCC
GGCTGGCAGAGCGCAGAGCTTGGAGGCCTCCACTGGGGCCAAGACTACGAGTTCAAAGTGAGACCATCCTCTGGC
CGGGCTCGAGGCCCTGACAGCAACGTGCTGCTCCTGAGGCTGCCGGAAAAAGTGCCCAGTGCCCCACCTCAGGAA
GTGACTCTAAAGCCTGGCAATGGCACTGTCTTTGTGAGCTGGGTCCCACCACCTGCTGAAAACCACAATGGCATC
ATCCGTGGCTACCAGGTCTGGAGCCTGGGCAACACATCACTGCCACCAGCCAACTGGACTGTAGTTGGTGAGCAG
ACCCAGCTGGAAATCGCCACCCATATGCCAGGCTCCTACTGCGTGCAAGTGGCTGCAGTCACTGGTGCTGGAGCT
GGGGAGCCCAGTAGACCTGTCTGCCTCCTTTTAGAGCAGGCCATGGAGCGAGCCACCCAAGAACCCAGTGAGCAT
GGTCCCTGGACCCTGGAGCAGCTGAGGGCTACCTTGAAGCGGCCTGAGGTCATTGCCACCTGCGGTGTTGCACTC
TGGCTGCTGCTTCTGGGCACCGCCGTGTGTATCCACCGCCGGCGCCGAGCTAGGGTGCACCTGGGCCCAGGTCTG
TACAGATATACCAGTGAGGATGCCATCCTAAAACACAGGATGGATCACAGTGACTCCCAGTGGTTGGCAGACACT
TGGCGTTCCACCTCTGGCTCTCGGGACCTGAGCAGCAGCAGCAGCCTCAGCAGTCGGCTGGGGGCGGATGCCCGG
GACCCACTAGACTGTCGTCGCTCCTTGCTCTCCTGGGACTCCCGAAGCCCCGGCGTGCCCCTGCTTCCAGACACC
AGCACTTTTTATGGCTCCCTCATCGCTGAGCTGCCCTCCAGTACCCCAGCCAGGCCAAGTCCCCAGGTCCCAGCT
GTCAGGCGCCTCCCACCCCAGCTGGCCCAGCTCTCCAGCCCCTGTTCCAGCTCAGACAGCCTCTGCAGCCGCAGG
GGACTCTCTTCTCCCCGCTTGTCTCTGGCCCCTGCAGAGGCTTGGAAGGCCAAAAAGAAGCAGGAGCTGCAGCAT
GCCAACAGTTCCCCACTGCTCCGGGGCAGCCACTCCTTGGAGCTCCGGGCCTGTGAGTTAGGAAATAGAGGTTCC
AAGAACCTTTCCAAAGCCCAGGAGCTGTGCCCCAAGCTCTGGTTGCCTGGCGGGCCCTGGGACCGAAACTCCTC
AGCTCCTCAAATGAGCTGGTTACTCGTCATCTCCCTCCAGCACCCCTCTTTCCTCATGAAACTCCCCCAACTCAG
AGTCAACAGACCCAGCCTCCGGTGGCACCACAGGCTCCCTCCTCCATCCTGCTGCCAGCAGCCCCCATCCCCATC
CTTAGCCCCTGCAGTCCCCCTAGCCCCCAGGCCTCTTCCCTCTCTGGCCCCAGCCCAGCTTCCAGTCGCCTGTCC
AGCTCCTCACTGTCATCCCTGGGGGAGGATCAAGACAGCGTGCTGACCCCTGAGGAGGTAGCCCTGTGCTTGGAA
CTCAGTGAGGGTGAGGAGACTCCCAGGAACAGCGTCTCTCCCATGCCAAGGGCTCCTTCACCCCCCACCACCTAT
GGGTACATCAGCGTCCCAACAGCCTCAGAGTTCACGGACATGGGCAGGACTGGAGGAGGGGTGGGGCCCAAGGGG
GGAGTCTTGCTGTGCCCACCTCGGCCCTGCCTCACCCCCACCCCCAGCGAGGGCTCCTTAGCCAATGGTTGGGGC
TCAGCCTCTGAGGACAATGCCGCCAGCGCCAGAGCCAGCCTTGTCAGCTCCTCCGATGGCTCCTTCCTCGCTGAT
GCTCACTTTGCCCGGGCCCTGGCAGTGGCTGTGGATAGCTTTGGTTTCGGTCTAGAGCCCAGGGAGGCAGACTGC
GTCTTCATAGATGCCTCATCACCTCCCTCCCCACGGGATGAGATCTTCCTGACCCCCAACCTCTCCCTGCCCCTG
TGGGAGTGGAGGCCAGACTGGTTGGAAGACATGGAGGTCAGCCACACCCAGCGGCTGGGAAGGGGGATGCCTCCC
TGGCCCCCTGACTCTCAGATCTCTTCCCAGAGAAGTCAGCTCCACTGTCGTATGCCCAAGGCTGGTGCTTCTCCT
GTAGATTACTCCTGAACCGTGTCCCTGAGACTTCCCAGACGGGAATCAGAACCACTTCTCCTGTCCACCCACAAG
ACCTGGGCTGTGGTGTGTGGGTCTTGGCCTGTGTTTCTCTGCAGCTGGGGTCCACCTTCCCAAGCCTCCAGAGAG
TTCTCCCTCCACGATTGTGAAAACAAATGAAAACAAAATTAGAGCAAAGCTGACCTGGAGCCCTCAGGGAGCAAA
ACATCATCTCCACCTGACTCCTAGCCACTGCTTTCTCCTCTGTGCCATCCACTCCCACCACCAGGTTGTTTTGGC
CTGAGGAGCAGCCCTGCCTGCTGCTCTTCCCCCACCATTTGGATCACAGGAAGTGGAGGAGCCAGAGGTGCCTTT
GTGGAGGACAGCAGTGGCTGCTGGGAGAGGGCTGTGGAGGAAGGAGCTTCTCGGAGCCCCCTCTCAGCCTTACCT
GGGCCCCTCCTCTAGAGAAGAGCTCAACTCTCTCCCAACCTCACCATGGAAAGAAAATAATTATGAATGCCACTG
AGGCACTGAGGCCCTACCTCATGCCAAACAAAGGGTTCAAGGCTGGGTCTAGCGAGGATGCTGAAGGAAGGGAGG
TATGAGACCGTAGGTCAAAAGCACCATCCTCGTACTGTTGTCACTATGAGCTTAAGAAATTTGATACCATAAAAT
GGTAAAAAAAAAAAAAAAAAAAAAAAAAAAAAAAAAAAAAAAA
```

FIGURE 77

```
</usr/seqdb2/sst/DNA/Dnaseqs.min/ss.DNA41404
<subunit 1 of 1, 985 aa, 1 stop
<MW: 105336, pI: 6.55, NX(S/T): 7
MGGMAQDSPPQILVHPQDQLFQGPGPARMSCQASGQPPPTIRWLLNGQPLSMVPPDPHHLLP
DGTLLLLQPPARGHAHDGQALSTDLGVYTCEASNRLGTAVSRGARLSVAVLREDFQIQPRDM
VAVVGEQFTLECGPPWGHPEPTVSWWKDGKPLALQPGRHTVSGGSLLMARAEKSDEGTYMCV
ATNSAGHRESRAARVSIQEPQDYTEPVELLAVRIQLENVTLLNPDPAEGPKPRPAVWLSWKV
SGPAAPAQSYTALFRTQTAPGGQGAPWAEELLAGWQSAELGGLHWGQDYEFKVRPSSGRARG
PDSNVLLLRLPEKVPSAPPQEVTLKPGNGTVFVSWVPPPAENHNGIIRGYQVWSLGNTSLPP
ANWTVVGEQTQLEIATHMPGSYCVQVAAVTGAGAGEPSRPVCLLLEQAMERATQEPSEHGPW
TLEQLRATLKRPEVIATCGVALWLLLLGTAVCIHRRRRARVHLGPGLYRYTSEDAILKHRMD
HSDSQWLADTWRSTSGSRDLSSSSSLSSRLGADARDPLDCRRSLLSWDSRSPGVPLLPDTST
FYGSLIAELPSSTPARPSPQVPAVRRLPPQLAQLSSPCSSSDSLCSRRGLSSPRLSLAPAEA
WKAKKKQELQHANSSPLLRGSHSLELRACELGNRGSKNLSQSPGAVPQALVAWRALGPKLLS
SSNELVTRHLPPAPLFPHETPPTQSQQTQPPVAPQAPSSILLPAAPIPILSPCSPPSPQASS
LSGPSPASSRLSSSSLSSLGEDQDSVLTPEEVALCLELSEGEETPRNSVSPMPRAPSPPTTY
GYISVPTASEFTDMGRTGGGVGPKGGVLLCPPRPCLTPTPSEGSLANGWGSASEDNAASARA
SLVSSSDGSFLADAHFARALAVAVDSFGFGLEPREADCVFIDASSPPSPRDEIFLTPNLSLP
LWEWRPDWLEDMEVSHTQRLGRGMPPWPPDSQISSQRSQLHCRMPKAGASPVDYS
```

Important features:

Transmembrane domain:

amino acids 448-467

N-glycosylation sites:

amino acids 224-227, 338-341, 367-370, 374-377, 658-661 and 926-929

N-myristoylation sites.

amino acids 47-52, 80-85, 88-93, 99-104, 105-110, 181-186, 272-277, 290-295, 355-360, 403-408, 462-467, 561-566, 652-657, 849-854 and 876-881

Phosphotyrosine interaction domain proteins amino acids 740-753

FIGURE 78

CTCCCACGGTGTCCAGCGCCCAGAATGCGGCTTCTGGTCCTGCTATGGGGTTGCCTGCTGCT
CCCAGGTTATGAAGCCCTGGAGGGCCCAGAGGAAATCAGCGGGTTCGAAGGGGACACTGTGT
CCCTGCAGTGCACCTACAGGGAAGAGCTGAGGGACCACCGGAAGTACTGGTGCAGGAAGGGT
GGGATCCTCTTCTCTCGCTGCTCTGGCACCATCTATGCAGAAGAAGAAGGCCAGGAGACAAT
GAAGGGCAGGGTGTCCATCCGTGACAGCCGCCAGGAGCTCTCGCTCATTGTGACCCTGTGGA
ACCTCACCCTGCAAGACGCTGGGGAGTACTGGTGTGGGGTCGAAAAACGGGGCCCCGATGAG
TCTTTACTGATCTCTCTGTTCGTCTTTCCAGGACCCTGCTGTCCTCCCTCCCCTTCTCCCAC
CTTCCAGCCTCTGGCTACAACACGCCTGCAGCCCAAGGCAAAAGCTCAGCAAACCCAGCCCC
CAGGATTGACTTCTCCTGGGCTCTACCCGGCAGCCACCACAGCCAAGCAGGGGAAGACAGGG
GCTGAGGCCCCTCCATTGCCAGGGACTTCCCAGTACGGGCACGAAAGGACTTCTCAGTACAC
AGGAACCTCTCCTCACCCAGCGACCTCTCCTCCTGCAGGGAGCTCCCGCCCCCCATGCAGC
TGGACTCCACCTCAGCAGAGGACACCAGTCCAGCTCTCAGCAGTGGCAGCTCTAAGCCCAGG
GTGTCCATCCCGATGGTCCGCATACTGGCCCCAGTCCTGGTGCTGCTGAGCCTTCTGTCAGC
CGCAGGCCTGATCGCCTTCTGCAGCCACCTGCTCCTGTGGAGAAAGGAAGCTCAACAGGCCA
CGGAGACACAGAGGAACGAGAAGTTCTGGCTCTCACGCTTGACTGCGGAGGAAAAGGAAGCC
CCTTCCCAGGCCCCTGAGGGGACGTGATCTCGATGCCTCCCCTCCACACATCTGAGGAGGA
GCTGGGCTTCTCGAAGTTTGTCTCAGCGTAGGGCAGGAGGCCCTCCTGGCCAGGCCAGCAGT
GAAGCAGTATGGCTGGCTGGATCAGCACCGATTCCCGAAAGCTTTCCACCTCAGCCTCAGAG
TCCAGCTGCCCGGACTCCAGGGCTCTCCCCACCCTCCCCAGGCTCTCCTCTTGCATGTTCCA
GCCTGACCTAGAAGCGTTTGTCAGCCCTGGAGCCCAGAGCGGTGGCCTTGCTCTTCCGGCTG
GAGACTGGGACATCCCTGATAGGTTCACATCCCTGGGCAGAGTACCAGGCTGCTGACCCTCA
GCAGGGCCAGACAAGGCTCAGTGGATCTGGTCTGAGTTTCAATCTGCCAGGAACTCCTGGGC
CTCATGCCCAGTGTCGGACCCTGCCTTCCTCCCACTCCAGACCCCACCTTGTCTTCCCTCCC
TGGCGTCCTCAGACTTAGTCCCACGGTCTCCTGCATCAGCTGGTGATGAAGAGGAGCATGCT
GGGGTGAGACTGGGATTCTGGCTTCTCTTTGAACCACCTGCATCCAGCCCTTCAGGAAGCCT
GTGAAAAACGTGATTCCTGGCCCCACCAAGACCCACCAAAACCATCTCTGGGCTTGGTGCAG
GACTCTGAATTCTAACAATGCCCAGTGACTGTCGCACTTGAGTTTGAGGGCCAGTGGGCCTG
ATGAACGCTCACACCCCTTCAGCTTAGAGTCTGCATTTGGGCTGTGACGTCTCCACCTGCCC
CAATAGATCTGCTCTGTCTGCGACACCAGATCCACGTGGGGACTCCCCTGAGGCCTGCTAAG
TCCAGGCCTTGGTCAGGTCAGGTGCACATTGCAGGATAAGCCCAGGACCGGCACAGAAGTGG
TTGCCTTTNCCATTTGCCCTCCCTGGNCCATGCCTTCTTGCCTTTGGAAAAAATGATGAAGA
AAACCTTGGCTCCTTCCTTGTCTGGAAAGGGTTACTTGCCTATGGGTTCTGGTGGCTAGAGA
GAAAAGTAGAAAACCAGAGTGCACGTAGGTGTCTAACACAGAGGAGAGTAGGAACAGGGCGG
ATACCTGAAGGTGACTCCGAGTCCAGCCCCCTGGAGAAGGGGTCGGGGGTGGTGGTAAAGTA
GCACAACTACTATTTTTTTTCTTTTTCCATTATTATTGTTTTTTAAGACAGAATCTCGTGCT
GCTGCCCAGGCTGGAGTGCAGTGGCACGATCTGCAAACTCCGCCTCCTGGGTTCAAGTGATT
CTTCTGCCTCAGCCTCCCGAGTAGCTGGGATTACAGGCACGCACCACCACACCTGGCTAATT
TTTGTACTTTTAGTAGAGATGGGGTTTCACCATGTTGGCCAGGCTGGTCTTGAACTCCTGAC
CTCAAATGAGCCTCCTGCTTCAGTCTCCCAAATTGCCGGGATTACAGGCATGAGCCACTGTG
TCTGGCCCTATTTCCTTTAAAAAGTGAAATTAAGAGTTGTTCAGTATGCAAAACTTGGAAAG
ATGGAGGAGAAAAAGAAAAGGAAGAAAAAAATGTCACCCATAGTCTCACCAGAGACTATCAT
TATTTCGTTTTGTTGTACTTCCTTCCACTCTTTTCTTCTTCACATAATTTGCCGGTGTTCTT
TTTACAGAGCAATTATCTTGTATATACAACTTTGTATCCTGCCTTTTCCACCTTATCGTTCC
ATCACTTTATTCCAGCACTTCTCTGTGTTTTACAGACCTTTTTATAAATAAATGTTCATCA
GCTGCATAAAAAAAAAAAAAAA

FIGURE 79

</usr/seqdb2/sst/DNA/Dnaseqs.min/ss.DNA44196
<subunit 1 of 1, 332 aa, 1 stop
<MW: 36143, pI: 5.89, NX(S/T): 1
MRLLVLLWGCLLLPGYEALEGPEEISGFEGDTVSLQCTYREELRDHRKYWCRKGGILFSRCS
GTIYAEEEGQETMKGRVSIRDSRQELSLIVTLWNLTLQDAGEYWCGVEKRGPDESLLISLFV
FPGPCCPPSPSPTFQPLATTRLQPKAKAQQTQPPGLTSPGLYPAATTAKQGKTGAEAPPLPG
TSQYGHERTSQYTGTSPHPATSPPAGSSRPPMQLDSTSAEDTSPALSSGSSKPRVSIPMVRI
LAPVLVLLSLLSAAGLIAFCSHLLLWRKEAQQATETQRNEKFWLSRLTAEEKEAPSQAPEGD
VISMPPLHTSEEELGFSKFVSA Important features:
Signal peptide:
amino acids 1-17

Transmembrane domain:
amino acids 248-269

N-glycosylation site.
amino acids 96-99

Fibrinogen beta and gamma chains C-terminal domain.
amino acids 104-113

Ig like V-type domain:
amino acids 13-128

FIGURE 80

TTGTGACTAAAAGCTGGCCTAGCAGGCCAGGGAGTGCAGCTGCAGGCGTGGGGGTGGCAGGA
GCCGCAGAGCCAGAGCAGACAGCCGAGAAACAGGTGGACAGTGTGAAAGAACCAGTGGTCTC
GCTCTGTTGCCCAGGCTAGAGTGTACTGGCGTGATCATAGCTCACTGCAGCCTCAGACTCCT
GGACTTGAGAAATCCTCCTGCCTTAGCCTCCTGCATATCTGGGACTCCAGGGGTGCACTCAA
GCCCTGTTTCTTCTCCTTCTGTGAGTGGACCACGGAGGCTGGTGAGCTGCCTGTCATCCCAA
AGCTCAGCTCTGAGCCAGAGTGGTGGTGGCTCCACCTCTGCCGCCGGCATAGAAGCCAGGAG
CAGGGCTCTCAGAAGGCGGTGGTGCCCAGCTGGGATCATGTTGTTGGCCCTGGTCTGTCTGC
TCAGCTGCCTGCTACCCTCCAGTGAGGCCAAGCTCTACGGTCGTTGTGAACTGGCCAGAGTG
CTACATGACTTCGGGCTGGACGGATACCGGGGATACAGCCTGGCTGACTGGGTCTGCCTTGC
TTATTTCACAAGCGGTTTCAACGCAGCTGCTTTGGACTACGAGGCTGATGGGAGCACCAACA
ACGGGATCTTCCAGATCAACAGCCGGAGGTGGTGCAGCAACCTCACCCCGAACGTCCCCAAC
GTGTGCCGGATGTACTGCTCAGATTTGTTGAATCCTAATCTCAAGGATACCGTTATCTGTGC
CATGAAGATAACCCAAGAGCCTCAGGGTCTGGGTTACTGGGAGGCCTGGAGGCATCACTGCC
AGGGAAAAGACCTCACTGAATGGGTGGATGGCTGTGACTTCTAGGATGGACGGAACCATGCA
CAGCAGGCTGGGAAATGTGGTTTGGTTCCTGACCTAGGCTTGGGAAGACAAGCCAGCGAATA
AAGGATGGTTGAACGTGAAA

FIGURE 81

</usr/seqdb2/sst/DNA/Dnaseqs.min/ss.DNA52187
<subunit 1 of 1, 146 aa, 1 stop
<MW: 16430, pI: 5.05, NX(S/T): 1

MLLALVCLLSCLLPSSEAKLYGRCELARVLHDFGLDGYRGYSLADWVCLAYFTSGFNAAALD
YEADGSTNNGIFQINSRRWCSNLTPNVPNVCRMYCSDLLNPNLKDTVICAMKITQEPQGLGY
WEAWRHHCQGKDLTEWVDGCDF

Important features:

Signal peptide:

amino acids 1-18

N-myristoylation site.

amino acids 67-72

Homolgous region to Alpha-lactalbumin / lysozyme C proteins.

amino acids 34-58 (catalytic domain), 111-132 and 66-107

FIGURE 82

AGCCGCTGCCCCGGGCCGGGCGCCCGCGGCGGCACCATGAGTCCCCGCTCGTGCCTGCGTTC
GCTGCGCCTCCTCGTCTTCGCCGTCTTCTCAGCCGCCGCGAGCAACTGGCTGTACCTGGCCA
AGCTGTCGTCGGTGGGGAGCATCTCAGAGGAGGAGACGTGCGAGAAACTCAAGGGCCTGATC
CAGAGGCAGGTGCAGATGTGCAAGCGGAACCTGGAAGTCATGGACTCGGTGCGCCGCGGTGC
CCAGCTGGCCATTGAGGAGTGCCAGTACCAGTTCCGGAACCGGCGCTGGAACTGCTCCACAC
TCGACTCCTTGCCCGTCTTCGGCAAGGTGGTGACGCAAGGGACTCGGGAGGCGGCCTTCGTG
TACGCCATCTCTTCGGCAGGTGTGGCCTTTGCAGTGACGCGGGCGTGCAGCAGTGGGGAGCT
GGAGAAGTGCGGCTGTGACAGGACAGTGCATGGGGTCAGCCCACAGGGCTTCCAGTGGTCAG
GATGCTCTGACAACATCGCCTACGGTGTGGCCTTCTCACAGTCGTTTGTGGATGTGCGGGAG
AGAAGCAAGGGGGCCTCGTCCAGCAGAGCCCTCATGAACCTCCACAACAATGAGGCCGGCAG
GAAGGCCATCCTGACACACATGCGGGTGGAATGCAAGTGCCACGGGGTGTCAGGCTCCTGTG
AGGTAAAGACGTGCTGGCGAGCCGTGCCGCCCTTCCGCCAGGTGGGTCACGCACTGAAGGAG
AAGTTTGATGGTGCCACTGAGGTGGAGCCACGCCGCGTGGGCTCCTCCAGGGCACTGGTACC
ACGCAACGCACAGTTCAAGCCGCACACAGATGAGGACCTGGTGTACTTGGAGCCTAGCCCCG
ACTTCTGTGAGCAGGACATGCGCAGCGGCGTGCTGGGCACGAGGGGCCGCACATGCAACAAG
ACGTCCAAGGCCATCGACGGCTGTGAGCTGCTGTGCTGTGGCCGCGGCTTCCACACGGCGCA
GGTGGAGCTGGCTGAACGCTGCAGCTGCAAATTCCACTGGTGCTGCTTCGTCAAGTGCCGGC
AGTGCCAGCGGCTCGTGGAGTTGCACACGTGCCGATGACCGCCTGCCTAGCCCTGCGCCGGC
AACCACCTAGTGGCCCAGGGAAGGCCGATAATTTAAACAGTCTCCCACCACCTACCCCAAGA
GATACTGGTTGTATTTTTTGTTCTGGTTTGGTTTTTGGGTCCTCATGTTATTTATTGCCGAA
ACCAGGCAGGCAACCCCAAGGGCACCAACCAGGGCCTCCCCAAAGCCTGGGCCTTTGTGGCT
GCCACTGACCAAAGGGACCTTGCTCGTGCCGCTGGCTGCCCGCATGTGGCTGCCACTGACCA
CTCAGTTGTTATCTGTGTCCGTTTTTCTACTTGCAGACCTAAGGTGGAGTAACAAGGAGTAT
TACCACCACATGGCTACTGACCGTGTCATCGGGGAAGAGGGGGCCTTATGGCAGGGAAAATA
GGTACCGACTTGATGGAAGTCACACCCTCTGGAAAAAAGAACTCTTAACTCTCCAGCACACA
TACACATGGACTCCTGGCAGCTTGAGCCTAGAAGCCATGTCTCTCAAATGCCCTGAGAAAGG
GAACAAGCAGATACCAGGTCAAGGGCACCAGGTTCATTTCAGCCCTTACATGGACAGCTAGA
GGTTCGATATCTGTGGGTCCTTCCAGGCAAGAAGAGGGAGATGAGAGCAAGAGACGACTGAA
GTCCCACCCTAGAACCCAGCCTGCCCCAGCCTGCCCCTGGGAAGAGGAAACTTAACCACTCC
CCAGACCCACCTAGGCAGGCATATAGGCTGCCATCCTGGACCAGGGATCCCGGCTGTGCCTT
TGCAGTCATGCCCGAGTCACCTTTCACAGCGCTGTTCCTCCATGAAACTGAAAAACACACAC
ACACACACACACACACACACACACACACACACGGACACACACACACCTGCGAGA
GAGAGGGAGGAAAGGGCTGTGCCTTTGCAGTCATGCCCGAGTCACCTTTCACAGCACTGTTCCTC

FIGURE 83

</usr/seqdb2/sst/DNA/Dnaseqs.min/ss.DNA48328
<subunit 1 of 1, 351 aa, 1 stop
<MW: 39052, pI: 8.97, NX(S/T): 2

MSPRSCLRSLRLLVFAVFSAAASNWLYLAKLSSVGSISEEETCEKLKGLIQRQVQMCKRNLE
VMDSVRRGAQLAIEECQYQFRNRRWNCSTLDSLPVFGKVVTQGTREAAFVYAISSAGVAFAV
TRACSSGELEKCGCDRTVHGVSPQGFQWSGCSDNIAYGVAFSQSFVDVRERSKGASSSRALM
NLHNNEAGRKAILTHMRVECKCHGVSGSCEVKTCWRAVPPFRQVGHALKEKFDGATEVEPRR
VGSSRALVPRNAQFKPHTDEDLVYLEPSPDFCEQDMRSGVLGTRGRTCNKTSKAIDGCELLC
CGRGFHTAQVELAERCSCKFHWCCFVKCRQCQRLVELHTCR

Important features:
Signal peptide:
amino acids 1-22

N-glycosylation sites.
amino acids 88-91 and 297-300

Wnt-1 family signature.
amino acids 206-215

Homologous region to Wnt-1 family proteins
amino acids 183-235, 305-350, 97-138, 53-92 and 150-174

FIGURE 84

CGGACGCGTGGGCGGACGCGTGGGCGGACGCGTGGGCGGACGCGTGGGCTGGGTGCCTGCAT
CGCCATGGACACCACCAGGTACAGCAAGTGGGGCGGCAGCTCCGAGGAGGTCCCCGGAGGGC
CCTGGGGACGCTGGGTGCACTGGAGCAGGAGACCCCTCTTCTTGGCCCTGGCTGTCCTGGTC
ACCACAGTCCTTTGGGCTGTGATTCTGAGTATCCTATTGTCCAAGGCCTCCACGGAGCGCGC
GGCGCTGCTTGACGGCCACGACCTGCTGAGGACAAACGCCTCGAAGCAGACGGCGGCGCTGG
GTGCCCTGAAGGAGGAGGTCGGAGACTGCCACAGCTGCTGCTCGGGGACGCAGGCGCAGCTG
CAGACCACGCGCGCGGAGCTTGGGGAGGCGCAGGCGAAGCTGATGGAGCAGGAGAGCGCCCT
GCGGGAACTGCGTGAGCGCGTGACCCAGGGCTTGGCTGAAGCCGGCAGGGCCGTGAGGACG
TCCGCACTGAGCTGTTCCGGGCGCTGGAGGCCGTGAGGCTCCAGAACAACTCCTGCGAGCCG
TGCCCCACGTCGTGGCTGTCCTTCGAGGGCTCCTGCTACTTTTTCTCTGTGCCAAAGACGAC
GTGGGCGGCGGCGCAGGATCACTGCGCAGATGCCAGCGCGCACCTGGTGATCGTTGGGGGCC
TGGATGAGCAGGGCTTCCTCACTCGGAACACGCGTGGCCGTGGTTACTGGCTGGGCCTGAGG
GCTGTGCGCCATCTGGGCAAGGTTCAGGGCTACCAGTGGGTGGACGGAGTCTCTCTCAGCTT
CAGCCACTGGAACCAGGGAGAGCCCAATGACGCTTGGGGGCGCGAGAACTGTGTCATGATGC
TGCACACGGGGCTGTGGAACGACGCACCGTGTGACAGCGAGAAGGACGGCTGGATCTGTGAG
AAAAGGCACAACTGCTGACCCCGCCCAGTGCCCTGGAGCCGCGCCCATTGCAGCATGTCGTA
TCCTGGGGGCTGCTCACCTCCTGGCTCCTGGAGCTGATTGCCAAAGAGTTTTTTTCTTCCT
CATCCACCGCTGCTGAGTCTCAGAAACACTTGGCCCAACATAGCCCTGTCCAGCCCAGTGCC
TGGGCTCTGGGACCTCCATGCCGACCTCATCCTAACTCCACTCACGCAGACCCAACCTAACC
TCCACTAGCTCCAAAATCCCTGCTCCTGCGTCCCCGTGATATGCCTCCACTTCTCTCCCTAA
CCAAGGTTAGGTGACTGAGGACTGGAGCTGTTTGGTTTTCTCGCATTTTCCACCAAACTGGA
AGCTGTTTTTGCAGCCTGAGGAAGCATCAATAAATATTTGAGAAATGAAAAAA

FIGURE 85

</usr/seqdb2/sst/DNA/Dnaseqs.min/ss.DNA56352
<subunit 1 of 1, 293 aa, 1 stop
<MW: 32562, pI: 6.53, NX(S/T): 2

MDTTRYSKWGGSSEEVPGGPWGRWVHWSRRPLFLALAVLVTTVLWAVILSILLSKASTERAA
LLDGHDLLRTNASKQTAALGALKEEVGDCHSCCSGTQAQLQTTRAELGEAQAKLMEQESALR
ELRERVTQGLAEAGRGREDVRTELFRALEAVRLQNNSCEPCPTSWLSFEGSCYFFSVPKTTW
AAAQDHCADASAHLVIVGGLDEQGFLTRNTRGRGYWLGLRAVRHLGKVQGYQWVDGVSLSFS
HWNQGEPNDAWGRENCVMMLHTGLWNDAPCDSEKDGWICEKRHNC

Important features:

Type II transmembrane domain:

amino acids 31-54

N-glycosylation sites.

amino acids 73-76 and 159-162

Leucine zipper pattern.

amino acids 102-123

N-myristoylation sites.

amino acids 18-23, 133-138 and 242-247

C-type lectin domain signature.

amino acids 264-287

FIGURE 86

```
GCCAGGGGAAGAGGGTGATCCGACCCGGGGAAGGTCGCTGGGCAGGGCGAGTTGGGAAAGCG
GCAGCCCCGCCGCCCCGCAGCCCCTTCTCCTCCTTTCTCCCACGTCCTATCTGCCTCTCG
CTGGAGGCCAGGCCGTGCAGCATCGAAGACAGGAGGAACTGGAGCCTCATTGGCCGGCCCGG
GGCGCCGGCCTCGGGCTTAAATAGGAGCTCCGGGCTCTGGCTGGGACCCGACCGCTGCCGGC
CGCGCTCCCGCTGCTCCTGCCGGGTGATGGAAAACCCCAGCCCGGCCGCCGCCCTGGGCAAG
GCCCTCTGCGCTCTCCTCCTGGCCACTCTCGGCGCCGCCGGCCAGCCTCTTGGGGGAGAGTC
CATCTGTTCCGCCAGAGCCCCGGCCAAATACAGCATCACCTTCACGGGCAAGTGGAGCCAGA
CGGCCTTCCCCAAGCAGTACCCCCTGTTCCGCCCCCTGCGCAGTGGTCTTCGCTGCTGGGG
GCCGCGCATAGCTCCGACTACAGCATGTGGAGGAAGAACCAGTACGTCAGTAACGGGCTGCG
CGACTTTGCGGAGCGCGGCGAGGCCTGGGCGCTGATGAAGGAGATCGAGGCGGCGGGGGAGG
CGCTGCAGAGCGTGCACGAGGTGTTTTCGGCGCCCGCCGTCCCCAGCGGCACCGGGCAGACG
TCGGCGGAGCTGGAGGTGCAGCGCAGGCACTCGCTGGTCTCGTTTGTGGTGCGCATCGTGCC
CAGCCCCGACTGGTTCGTGGGCGTGGACAGCCTGGACCTGTGCGACGGGGACCGTTGGCGGG
AACAGGCGGCGCTGGACCTGTACCCCTACGACGCCGGGACGGACAGCGGCTTCACCTTCTCC
TCCCCCAACTTCGCCACCATCCCGCAGGACACGGTGACCGAGATAACGTCCTCCTCTCCCAG
CCACCCGGCCAACTCCTTCTACTACCCGCGGCTGAAGGCCCTGCCTCCCATCGCCAGGGTGA
CACTGCTGCGGCTGCGACAGAGCCCCAGGGCCTTCATCCCTCCCGCCCCAGTCCTGCCCAGC
AGGGACAATGAGATTGTAGACAGCGCCTCAGTTCCAGAAACGCCGCTGGACTGCGAGGTCTC
CCTGTGGTCGTCCTGGGGACTGTGCGGAGGCCACTGTGGGAGGCTCGGGACCAAGAGCAGGA
CTCGCTACGTCCGGGTCCAGCCCGCCAACAACGGGAGCCCCTGCCCCGAGCTCGAAGAAGAG
GCTGAGTGCGTCCCTGATAACTGCGTCTAAGACCAGAGCCCCGCAGCCCCTGGGGCCCCCCG
GAGCCATGGGGTGTCGGGGGCTCCTGTGCAGGCTCATGCTGCAGGCGGCCGAGGGCACAGGG
GGTTTCGCGCTGCTCCTGACCGCGGTGAGGCCGCGCCGACCATCTCTGCACTGAAGGGCCCT
CTGGTGGCCGGCACGGGCATTGGGAAACAGCCTCCTCCTTTCCCAACCTTGCTTCTTAGGGG
CCCCCGTGTCCCGTCTGCTCTCAGCCTCCTCCTCCTGCAGGATAAAGTCATCCCCAAGGCTC
CAGCTACTCTAAATTATGTCTCCTTATAAGTTATTGCTGCTCCAGGAGATTGTCCTTCATCG
TCCAGGGGCCTGGCTCCCACGTGGTTGCAGATACCTCAGACCTGGTGCTCTAGGCTGTGCTG
AGCCCACTCTCCCGAGGGCGCATCCAAGCGGGGCCACTTGAGAAGTGAATAAATGGGGCGG
TTTCGGAAGCGTCAGTGTTTCCATGTTATGGATCTCTCTGCGTTTGAATAAAGACTATCTCT
GTTGCTCACAAAAAAAAAAAAAAAAAAAAAAAAAAAAAAAAAAAAAAAAAA
```

FIGURE 87

></usr/seqdb2/sst/DNA/Dnaseqs.min/ss.DNA53971
><subunit 1 of 1, 331 aa, 1 stop
><MW: 35844, pI: 5.45, NX(S/T): 2
MENPSPAAALGKALCALLLATLGAAGQPLGGESICSARAPAKYSITFTGKWSQTAFPKQYPL
FRPPAQWSSLLGAAHSSDYSMWRKNQYVSNGLRDFAERGEAWALMKEIEAAGEALQSVHEVF
SAPAVPSGTGQTSAELEVQRRHSLVSFVVRIVPSPDWFVGVDSLDLCDGDRWREQAALDLYP
YDAGTDSGFTFSSPNFATIPQDTVTEITSSSPSHPANSFYYPRLKALPPIARVTLLRLRQSP
RAFIPPAPVLPSRDNEIVDSASVPETPLDCEVSLWSSWGLCGGHCGRLGTKSRTRYVRVQPA
NNGSPCPELEEEAECVPDNCV Important features:
Signal peptide:
amino acids 1-26

FIGURE 88

GGCGGCGTCCGTGAGGGGCTCCTTTGGGCAGGGGTAGTGTTTGGTGTCCCTGTCTTGCGTGA
TATTGACAAACTGAAGCTTTCCTGCACCACTGGACTTAAGGAAGAGTGTACTCGTAGGCGGA
CAGCTTTAGTGGCCGGCCGGCCGCTCTCATCCCCGTAAGGAGCAGAGTCCTTTGTACTGAC
CAAGATGAGCAACATCTACATCCAGGAGCCTCCCACGAATGGGAAGGTTTTATTGAAAACTA
CAGCTGGAGATATTGACATAGAGTTGTGGTCCAAAGAAGCTCCTAAAGCTTGCAGAAATTTT
ATCCAACTTTGTTTGGAAGCTTATTATGACAATACCATTTTTCATAGAGTTGTGCCTGGTTT
CATAGTCCAAGGCGGAGATCCTACTGGCACAGGGAGTGGTGGAGAGTCTATCTATGGAGCGC
CATTCAAAGATGAATTTCATTCACGGTTGCGTTTTAATCGGAGAGGACTGGTTGCCATGGCA
AATGCTGGTTCTCATGATAATGGCAGCCAGTTTTTCTTCACACTGGGTCGAGCAGATGAACT
TAACAATAAGCATACCATCTTTGGAAAGGTTACAGGGGATACAGTATATAACATGTTGCGAC
TGTCAGAAGTAGACATTGATGATGACGAAAGACCACATAATCCACACAAAATAAAAAGCTGT
GAGGTTTTGTTTAATCCTTTTGATGACATCATTCCAAGGGAAATTAAAAGGCTGAAAAAAGA
GAAACCAGAGGAGGAAGTAAAGAAATTGAAACCCAAAGGCACAAAAAATTTTAGTTTACTTT
CATTTGGAGAGGAAGCTGAGGAAGAAGAGGAGGAAGTAAATCGAGTTAGTCAGAGCATGAAG
GGCAAAAGCAAAAGTAGTCATGACTTGCTTAAGGATGATCCACATCTCAGTTCTGTTCCAGT
TGTAGAAAGTGAAAAAGGTGATGCACCAGATTTAGTTGATGATGGAGAAGATGAAAGTGCAG
AGCATGATGAATATATTGATGGTGATGAAAAGAACCTGATGAGAGAAAGAATTGCCAAAAAA
TTAAAAAAGGACACAAGTGCGAATGTTAAATCAGCTGGAGAAGGAGAAGTGGAGAAGAAATC
AGTCAGCCGCAGTGAAGAGCTCAGAAAAGAAGCAAGACAATTAAAACGGGAACTCTTAGCAG
CAAAACAAAAAAAGTAGAAAATGCAGCAAAACAAGCAGAAAAAGAAGTGAAGAGGAAGAA
GCCCCTCCAGATGGTGCTGTTGCCGAATACAGAAGAGAAAAGCAAAAGTATGAAGCTTTGAG
GAAGCAACAGTCAAAGAAGGGAACTTCCCGGGAAGATCAGACCCTTGCACTGCTGAACCAGT
TTAAATCTAAACTCACTCAAGCAATTGCTGAAACACCTGAAAATGACATTCCTGAAACAGAA
GTAGAAGATGATGAAGGATGGATGTCACATGTACTTCAGTTTGAGGATAAAAGCAGAAAAGT
GAAAGATGCAAGCATGCAAGACTCAGATACATTTGAAATCTATGATCCTCGGAATCCAGTGA
ATAAAGAAGGAGGGAAGAAAGCAAAAGCTGATGAGAGAGAAAAAGAAAGAAGATAAAAT
GAGAATAATGATAACCAGAACTTGCTGGAAATGTGCCTACAATGGCCTTGTAACAGCCATTG
TTCCCAACAGCATCACTTAGGGGTGTGAAAGAAGTATTTTTGAACCTGTTGTCTGGTTTTG
AAAAACAATTATCTTGTTTTGCAAATTGTGGAATGATGTAAGCAAATGCTTTTGGTTACTGG
TACATGTGTTTTTTCCTAGCTGACCTTTTATATTGCTAAATCTGAAATAAAATAACTTTCCT
TCCACAAAAAAAAAAAAAAAAAAAAAAAAAAAA

FIGURE 89

></usr/seqdb2/sst/DNA/Dnaseqs.min/ss.DNA50919
><subunit 1 of 1, 472 aa, 1 stop
><MW: 53847, pI: 5.75, NX(S/T): 2

MSNIYIQEPPTNGKVLLKTTAGDIDIELWSKEAPKACRNFIQLCLEAYYDNTIFHRVVPGFI
VQGGDPTGTGSGGESIYGAPFKDEFHSRLRFNRRGLVAMANAGSHDNGSQFFFTLGRADELN
NKHTIFGKVTGDTVYNMLRLSEVDIDDDERPHNPHKIKSCEVLFNPFDDIIPREIKRLKKEK
PEEEVKKLKPKGTKNFSLLSFGEEAEEEEEVNRVSQSMKGKSKSSHDLLKDDPHLSSVPVV
ESEKGDAPDLVDDGEDESAEHDEYIDGDEKNLMRERIAKKLKKDTSANVKSAGEGEVEKKSV
SRSEELRKEARQLKRELLAAKQKKVENAAKQAEKRSEEEEAPPDGAVAEYRREKQKYEALRK
QQSKKGTSREDQTLALLNQFKSKLTQAIAETPENDIPETEVEDDEGWMSHVLQFEDKSRKVK
DASMQDSDTFEIYDPRNPVNKRRREESKKLMREKKERR

Important features:

Signal peptide:
amino acids 1-21

N-glycosylation sites.
amino acids 109-112 and 201-204

Cyclophilin-type peptidyl-prolyl cis-trans isomerase signature.
amino acids 49-66

Homologous region to Cyclophilin-type peptidyl-prolyl cis-trans isomerase
amino acids 96-140, 49-89 and 22-51

FIGURE 90

```
CGCCGCCGTTGGGGCTGGAAGTTCCCGCCAGGTCCGTGCCGGGCGAGAGAGATGCTGCCCGG
CCCGCCTCGGCTTTGAGGCGAGAGAAGTGTCCCAGACCCATTTCGCCTTGCTGACGGCGTCG
AGCCCTGGCCAGACATGTCCACAGGGTTCTCCTTCGGGTCCGGGACTCTGGGCTCCACCACC
GTGGCCGCCGGCGGGACCAGCACAGGCGGCGTTTTCTCCTTCGGAACGGGAACGTCTAGCAA
CCCTTCTGTGGGGCTCAATTTTGGAAATCTTGGAAGTACTTCAACTCCAGCAACTACATCTG
CTCCTTCAAGTGGTTTTGGAACCGGGCTCTTTGGATCTAAACCTGCCACTGGGTTCACTCTA
GGAGGAACAAATACAGGTGCCTTGCACACCAAGAGGCCTCAAGTGGTCACCAAATATGGAAC
CCTGCAAGGAAAACAGATGCATGTGGGGAAGACACCCATCCAAGTCTTTTTAGGAGTCCCCT
TCTCCAGACCTCCTCTAGGTATCCTCAGGTTTGCACCTCCAGAACCCCCGGAGCCCTGGAAA
GGAATCAGAGATGCTACCACCTACCCGCCTGGATGGAGTCTCGCTCTGTCGCCAGGCTGGAG
TGCAGTGGCACGATCTCGGCTCACTGCAACCTCCGCCTCCCGGGTTCAAGCGAGTCTCCTGC
CTCAGCCTCTGAGTGTCTGGGCTACAGGTGCCTGCAGGAGTCCTGGGGCCAGCTGGCCTCG
ATGTACGTCAGCACGCGGGAACGGTACAAGTGGCTGCGCTTCAGCGAGGACTGTCTGTACCT
GAACGTGTACGCGCCGGCGCGCGCCCGGGGATCCCCAGCTGCCAGTGATGGTCTGGTTCC
CGGGAGGCGCCTTCATCGTGGGCGCTGCTTCTTCGTACGAGGGCTCTGACTTGGCCGCCCGC
GAGAAAGTGGTGCTGGTGTTTCTGCAGCACAGGCTCGGCATCTTCGGCTTCCTGAGCACGGA
CGACAGCCACGCGCGCGGGAACTGGGGGCTGCTGGACCAGATGGCGGCTCTGCGCTGGGTGC
AGGAGAACATCGCAGCCTTCGGGGGAGACCCAGGAAATGTGACCCTGTTCGGCCAGTCGGCG
GGGGCCATGAGCATCTCAGGACTGATGATGTCACCCCTAGCCTCGGGTCTCTTCCATCGGGC
CATTTCCCAGAGTGGCACCGCGTTATTCAGACTTTTCATCACTAGTAACCCACTGAAAGTGG
CCAAGAAGGTTGCCCACCTGGCTGGATGCAACCACAACAGCACACAGATCCTGGTAAACTGC
CTGAGGGCACTATCAGGGACCAAGGTGATGCGTGTGTCCAACAAGATGAGATTCCTCCAACT
GAACTTCCAGAGAGACCCGGAAGAGATTATCTGGTCCATGAGCCCTGTGGTGGATGGTGTGG
TGATCCCAGATGACCCTTTGGTGCTCCTGACCCAGGGGAAGGTTTCATCTGTGCCCTACCTT
CTAGGTGTCAACAACCTGGAATTCAATTGGCTCTTGCCTTATAATATCACCAAGGAGCAGGT
ACCACTTGTGGTGGAGGAGTACCTGGACAATGTCAATGAGCATGACTGGAAGATGCTACGAA
ACCGTATGATGGACATAGTTCAAGATGCCACTTTCGTGTATGCCACACTGCAGACTGCTCAC
TACCACCGAGAAACCCCAATGATGGGAATCTGCCCTGCTGGCCACGCTACAACAAGGATGAA
AAGTACCTGCAGCTGGATTTTACCACAAGAGTGGGCATGAAGCTCAAGGAGAAGAAGATGGC
TTTTTGGATGAGTCTGTACCAGTCTCAAAGACCTGAGAAGCAGAGGCAATTCTAAGGGTGGC
TATGCAGGAAGGAGCCAAAGAGGGGTTTGCCCCACCATCCAGGCCCTGGGGAGACTAGCCA
TGGACATACCTGGGGACAAGAGTTCTACCCACCCCAGTTTAGAACTGCAGGAGCTCCCTGCT
GCCTCCAGGCCAAAGCTAGAGCTTTTGCCTGTTGTGTGGGACCTGCACTGCCCTTTCCAGCC
TGACATCCATGATGCCCCTCTACTTCACTGTTGACATCCAGTTAGGCCAGGCCCTGTCAAC
ACCACACTGTGCTCAGCTCTCCAGCCTCAGGACAACCTCTTTTTTTCCCTTCTTCAAATCCT
CCCACCCTTCAATGTCTCCTTGTGACTCCTTCTTATGGGAGGTCGACCCAGACTGCCACTGC
CCCTGTCACTGCACCCAGCTTGGCATTTACCATCCATCCTGCTCAACCTTGTTCCTGTCTGT
TCACATTGGCCTGGAGGCCTAGGGCAGGTTGTGACATGGAGCAAACTTTTGGTAGTTTGGGA
TCTTCTCTCCCACCCACACTTATCTCCCCAGGGCCACTCCAAAGTCTATACACAGGGGTGG
TCTCTTCAATAAAGAAGTGTTGATTAGAAAAAAAAAAA
```

FIGURE 91

</usr/seqdb2/sst/DNA/Dnaseqs.min/ss.DNA44179
<subunit 1 of 1, 545 aa, 1 stop
<MW: 58934, pI: 9.45, NX(S/T): 4

MSTGFSFGSGTLGSTTVAAGGTSTGGVFSFGTGTSSNPSVGLNFGNLGSTSTPATTSAPSSG
FGTGLFGSKPATGFTLGGTNTGALHTKRPQVVTKYGTLQGKQMHVGKTPIQVFLGVPFSRPP
LGILRFAPPEPPEPWKGIRDATTYPPGWSLALSPGWSAVARSRLTATSASRVQASLLPQPLS
VWGYRCLQESWGQLASMYVSTRERYKWLRFSEDCLYLNVYAPARAPGDPQLPVMVWFPGGAF
IVGAASSYEGSDLAAREKVVLVFLQHRLGIFGFLSTDDSHARGNWGLLDQMAALRWVQENIA
AFGGDPGNVTLFGQSAGAMSISGLMMSPLASGLFHRAISQSGTALFRLFITSNPLKVAKKVA
HLAGCNHNSTQILVNCLRALSGTKVMRVSNKMRFLQLNFQRDPEEIIWSMSPVVDGVVIPDD
PLVLLTQGKVSSVPYLLGVNNLEFNWLLPYNITKEQVPLVVEEYLDNVNEHDWKMLRNRMMD
IVQDATFVYATLQTAHYHRETPMMGICPAGHATTRMKSTCSWILPQEWA

Important features:

Signal peptide:

amino acids 1-29

Carboxylesterases type-B serine active site.

amino acids 312-327

Carboxylesterases type-B signature 2.

amino acids 218-228

N-glycosylation sites.

amino acids 318-321, 380-383 and 465-468

FIGURE 92

GAGAACAGGCCTGTCTCAGGCAGGCCCTGCGCCTCCTATGCGGAG<u>ATG</u>CTACTGCCACTGCT
GCTGTCCTCGCTGCTGGGCGGGTCCCAGGCTATGGATGGGAGATTCTGGATACGAGTGCAGG
AGTCAGTGATGGTGCCGGAGGGCCTGTGCATCTCTGTGCCCTGCTCTTTCTCCTACCCCCGA
CAAGACTGGACAGGGTCTACCCCAGCTTATGGCTACTGGTTCAAAGCAGTGACTGAGACAAC
CAAGGGTGCTCCTGTGGCCACAAACCACCAGAGTCGAGAGGTGGAAATGAGCACCCGGGGCC
GATTCCAGCTCACTGGGGATCCCGCCAAGGGGAACTGCTCCTTGGTGATCAGAGACGCGCAG
ATGCAGGATGAGTCACAGTACTTCTTTCGGGTGGAGAGAGGAAGCTATGTGACATATAATTT
CATGAACGATGGGTTCTTTCTAAAAGTAACAGTGCTCAGCTTCACGCCCAGACCCCAGGACC
ACAACACCGACCTCACCTGCCATGTGGACTTCTCCAGAAAGGGTGTGAGCGCACAGAGGACC
GTCCGACTCCGTGTGGCCTATGCCCCAGAGACCTTGTTATCAGCATTTCACGTGACAACAC
GCCAGCCCTGGAGCCCCAGCCCCAGGGAAATGTCCCATACCTGGAAGCCCAAAAAGGCCAGT
TCCTGCGGCTCCTCTGTGCTGCTGACAGCCAGCCCCTGCCACACTGAGCTGGGTCCTGCAG
AACAGAGTCCTCTCCTCGTCCCATCCCTGGGGCCCTAGACCCCTGGGGCTGGAGCTGCCCGG
GGTGAAGGCTGGGGATTCAGGGCGCTACACCTGCCGAGCGGAGAACAGGCTTGGCTCCCAGC
AGCGAGCCCTGGACCTCTCTGTGCAGTATCCTCCAGAGAACCTGAGAGTGATGGTTTCCCAA
GCAAACAGGACAGTCCTGGAAAACCTTGGGAACGGCACGTCTCTCCCAGTACTGGAGGGCCA
AAGCCTGTGCCTGGTCTGTGTCACACACAGCAGCCCCCAGCCAGGCTGAGCTGGACCCAGA
GGGGACAGGTTCTGAGCCCCTCCCAGCCCTCAGACCCCGGGGTCCTGGAGCTGCCTCGGGTT
CAAGTGGAGCACGAAGGAGAGTTCACCTGCCACGCTCGGCACCCACTGGGCTCCCAGCACGT
CTCTCTCAGCCTCTCCGTGCACTATAAGAAGGGACTCATCTCAACGGCATTCTCCAACGGAG
CGTTTCTGGGAATCGGCATCACGGCTCTTCTTTTCCTCTGCCTGGCCCTGATCATCATGAAG
ATTCTACCGAAGAGACGGACTCAGACAGAAACCCCGAGGCCCAGGTTCTCCCGGCACAGCAC
GATCCTGGATTACATCAATGTGGTCCCGACGGCTGGCCCCCTGGCTCAGAAGCGGAATCAGA
AAGCCACACCAAACAGTCCTCGGACCCCTCCTCCACCAGGTGCTCCCTCCCCAGAATCAAAG
AAGAACCAGAAAAAGCAGTATCAGTTGCCCAGTTTCCCAGAACCCAAATCATCCACTCAAGC
CCCAGAATCCCAGGAGAGCCAAGAGGAGCTCCATTATGCCACGCTCAACTTCCCAGGCGTCA
GACCCAGGCCTGAGGCCCGGATGCCCAAGGGCACCCAGGCGGATTATGCAGAAGTCAAGTTC
CAA<u>TGA</u>GGGTCTCTTAGGCTTTAGGACTGGGACTTCGGCTAGGGAGGAAGGTAGAGTAAGAG
GTTGAAGATAACAGAGTGCAAAGTTTCCTTCTCTCCCTCTCTCTCTCTCTTTCTCTCTCTCT
CTCTCTTTCTCTCTCTTTTAAAAAAACATCTGGCCAGGGCACAGTGGCTCACGCCTGTAATC
CCAGCACTTTGGGAGGTTGAGGTGGGCAGATCGCCTGAGGTCGGGAGTTCGAGACCAGCCTG
GCCAACTTGGTGAAACCCCGTCTCTACTAAAAATACAAAATTAGCTGGGCATGGTGGCAGG
CGCCTGTAATCCTACCTACTTGGGAAGCTGAGGCAGGAGAATCACTTGAACCTGGGAGACGG
AGGTTGCAGTGAGCCAAGATCACACCATTGCACGCCAGCCTGGGCAACAAAGCGAGACTCCA
TCTCAAAAAAAAATCCTCCAAATGGGTTGGGTGTCTGTAATCCCAGCACTTTGGGAGGCTA
AGGTGGGTGGATTGCTTGAGCCCAGGAGTTCGAGACCAGCCTGGGCAACATGGTGAAACCCC
ATCTCTACAAAAATACAAAACATAGCTGGGCTTGGTGGTGTGTGCCTGTAGTCCCAGCTGT
CAGACATTTAAACCAGAGCAACTCCATCTGGAATAGGAGCTGAATAAAATGAGGCTGAGACC
TACTGGGCTGCATTCTCAGACAGTGGAGGCATTCTAAGTCACAGGATGAGACAGGAGGTCCG
TACAAGATACAGGTCATAAAGACTTTGCTGATAAACAGATTGCAGTAAAGAAGCCAACCAA
ATCCCACCAAAACCAAGTTGGCCACGAGAGTGACCTCTGGTCGTCCTCACTGCTACACTCCT
GACAGCACCATGACAGTTTACAAATGCCATGGCAACATCAGGAAGTTACCCGATATGTCCCA
AAAGGGGGAGGAATGAATAATCCACCCCTTGTTTAGCAAATAAGCAAGAAATAACCATAAAA
GTGGGCAACCAGCAGCTCTAGGCGCTGCTCTTGTCTATGGAGTAGCCATTCTTTTGTTCCTT
TACTTTCTTAATAAACTTGCTTTCACCTTAAAAAAA

FIGURE 93

></usr/seqdb2/sst/DNA/Dnaseqs.min/ss.DNA54002
><subunit 1 of 1, 544 aa, 1 stop
><MW: 60268, pI: 9.53, NX(S/T): 3

MLLPLLLSSLLGGSQAMDGRFWIRVQESVMVPEGLCISVPCSFSYPRQDWTGSTPAYGYWFK
AVTETTKGAPVATNHQSREVEMSTRGRFQLTGDPAKGNCSLVIRDAQMQDESQYFFRVERGS
YVTYNFMNDGFFLKVTVLSFTPRPQDHNTDLTCHVDFSRKGVSAQRTVRLRVAYAPRDLVIS
ISRDNTPALEPQPQGNVPYLEAQKGQFLRLLCAADSQPPATLSWVLQNRVLSSSHPWGPRPL
GLELPGVKAGDSGRYTCRAENRLGSQQRALDLSVQYPPENLRVMVSQANRTVLENLGNGTSL
PVLEGQSLCLVCVTHSSPPARLSWTQRGQVLSPSQPSDPGVLELPRVQVEHEGEFTCHARHP
LGSQHVSLSLSVHYKKGLISTAFSNGAFLGIGITALLFLCLALIIMKILPKRRTQTETPRPR
FSRHSTILDYINVVPTAGPLAQKRNQKATPNSPRTPPPPGAPSPESKKNQKKQYQLPSFPEP
KSSTQAPESQESQEELHYATLNFPGVRPRPEARMPKGTQADYAEVKFQ

Important features:

Signal peptide:

amino acids 1-15

Transmembrane domain:

amino acids 399-418

N-glycosylation site.

amino acids 100-103, 297-300 and 306-309

Immunoglobulins and major histocompatibility complex proteins signature.

amino acids 365-371

FIGURE 94

```
TGAAGAGTAATAGTTGGAATCAAAAGAGTCAACGCAATGAACTGTTATTTACTGCTGCGTTT
TATGTTGGGAATTCCTCTCCTATGGCCTTGTCTTGGAGCAACAGAAAACTCTCAAACAAAGA
AGTCAAGCAGCCAGTGCGATCTCATTTGAGAGTGAAGCGTGGCTGGGTGTGGAACCAATTT
TTTGTACCAGAGGAAATGAATACGACTAGTCATCACATCGGCCAGCTAAGATCTGATTTAGA
CAATGGAAACAATTCTTTCCAGTACAAGCTTTTGGGAGCTGGAGCTGGAAGTACTTTTATCA
TTGATGAAAGAACAGGTGACATATATGCCATACAGAAGCTTGATAGAGAGGAGCGATCCCTC
TACATCTTAAGAGCCCAGGTAATAGACATCGCTACTGGAAGGGCTGTGGAACCTGAGTCTGA
GTTTGTCATCAAAGTTTCGGATATCAATGACAATGAACCAAAATTCCTAGATGAACCTTATG
AGGCCATTGTACCAGAGATGTCTCCAGAAGGAACATTAGTTATCCAGGTGACAGCAAGTGAT
GCTGACGATCCCTCAAGTGGTAATAATGCTCGTCTCCTCTACAGCTTACTTCAAGGCCAGCC
ATATTTTCTGTTGAACCAACAACAGGAGTCATAAGAATATCTTCTAAAATGGATAGAGAAC
TGCAAGATGAGTATTGGGTAATCATTCAAGCCAAGGACATGATTGGTCAGCCAGGAGCGTTG
TCTGGAACAACAAGTGTATTAATTAAACTTTCAGATGTTAATGACAATAAGCCTATATTTAA
AGAAAGTTTATACCGCTTGACTGTCTCTGAATCTGCACCCACTGGGACTTCTATAGGAACAA
TCATGGCATATGATAATGACATAGGAGAGAATGCAGAAATGGATTACAGCATTGAAGAGGAT
GATTCGCAAACATTTGACATTATTACTAATCATGAAACTCAAGAAGGAATAGTTATATTAAA
AAAGAAAGTGGATTTTGAGCACCAGAACCACTACGGTATTAGAGCAAAAGTTAAAAACCATC
ATGTTCCTGAGCAGCTCATGAAGTACCACACTGAGGCTTCCACCACTTTCATTAAGATCCAG
GTGGAAGATGTTGATGAGCCTCCTCTTTTCCTCCTTCCATATTATGTATTTGAAGTTTTTGA
AGAAACCCCACAGGGATCATTTGTAGGCGTGGTGTCTGCCACAGACCCAGACAATAGGAAAT
CTCCTATCAGGTATTCTATTACTAGGAGCAAAGTGTTCAATATCAATGATAATGGTACAATC
ACTACAAGTAACTCACTGGATCGTGAAATCAGTGCTTGGTACAACCTAAGTATTACAGCCAC
AGAAAAATACAATATAGAACAGATCTCTTCGATCCCACTGTATGTGCAAGTTCTTAACATCA
ATGATCATGCTCCTGAGTTCTCTCAATACTATGAGACTTATGTTTGTGAAAATGCAGGCTCT
GGTCAGGTAATTCAGACTATCAGTGCAGTGGATAGAGATGAATCCATAGAAGAGCACCATTT
TTACTTTAATCTATCTGTAGAAGACACTAACAATTCAAGTTTTACAATCATAGATAATCAAG
ATAACACAGCTGTCATTTTGACTAATAGAACTGGTTTTAACCTTCAAGAAGAACCTGTCTTC
TACATCTCCATCTTAATTGCCGACAATGGAATCCCGTCACTTACAAGTACAAACACCCTTAC
CATCCATGTCTGTGACTGTGGTGACAGTGGGAGCACACAGACCTGCCAGTACCAGGAGCTTG
TGCTTTCCATGGGATTCAAGACAGAAGTTATCATTGCTATTCTCATTTGCATTATGATCATA
TTTGGGTTTATTTTTTTGACTTTGGGTTTAAAACAACGGAGAAAACAGATTCTATTTCCTGA
GAAAGTGAAGATTTCAGAGAGAATATATTCCAATATGATGATGAAGGGGGTGGAGAAGAAG
ATACAGAGGCCTTTGATATAGCAGAGCTGAGGAGTAGTACCATAATGCGGGAACGAAGACT
CGGAAAACCACAAGCGCTGAGATCAGGAGCCTATACAGGCAGTCTTTGCAAGTTGGCCCCGA
CAGTGCCATATTCAGGAAATTCATTCTGGAAAAGCTCGAAGAAGCTAATACTGATCCGTGTG
CCCCTCCTTTTGATTCCCTCCAGACCTACGCTTTTGAGGGAACAGGGTCATTAGCTGGATCC
CTGAGCTCCTTAGAATCAGCAGTCTCTGATCAGGATGAAAGCTATGATTACCTTAATGAGTT
GGGACCTCGCTTTAAAAGATTAGCATGCATGTTTGGTTCTGCAGTGCAGTCAAATAATTAGG
GCTTTTTACCATCAAAATTTTTAAAAGTGCTAATGTGTATTCGAACCCAATGGTAGTCTTAA
AGAGTTTTGTGCCCTGGCTCTATGGCGGGGAAAGCCCTAGTCTATGGAGTTTTCTGATTTCC
CTGGAGTAAATACTCCATGGTTATTTTAAGCTACCTACATGCTGTCATTGAACAGAGATGTG
GGGAGAAATGTAAACAATCAGCTCACAGGCATCAATACAACCAGATTTGAAGTAAAATAATG
TAGGAAGATATTAAAAGTAGATGAGAGGACACAAGATGTAGTCGATCCTTATGCGATTATAT
CATTATTTACTTAGGAAAGAGTAAAAATACCAAACGAGAAATTTAAAGGAGCAAAAATTTG
CAAGTCAAATAGAAATGTACAAATCGAGATAACATTTACATTTCTATCATATTGACATGAAA
ATTGAAAATGTATAGTCAGAGAAATTTTCATGAATTATTCCATGAAGTATTGTTTCCTTTAT
TTAAA
```

FIGURE 95

></usr/seqdb2/sst/DNA/Dnaseqs.min/ss.DNA53906
><subunit 1 of 1, 772 aa, 1 stop
><MW: 87002, pI: 4.64, NX(S/T): 8

MNCYLLLRFMLGIPLLWPCLGATENSQTKKVKQPVRSHLRVKRGWVWNQFFVPEEMNTTSHH
IGQLRSDLDNGNNSFQYKLLGAGAGSTFIIDERTGDIYAIQKLDREERSLYILRAQVIDIAT
GRAVEPESEFVIKVSDINDNEPKFLDEPYEAIVPEMSPEGTLVIQVTASDADDPSSGNNARL
LYSLLQGQPYFSVEPTTGVIRISSKMDRELQDEYWVIIQAKDMIGQPGALSGTTSVLIKLSD
VNDNKPIFKESLYRLTVSESAPTGTSIGTIMAYDNDIGENAEMDYSIEEDDSQTFDIITNHE
TQEGIVILKKKVDFEHQNHYGIRAKVKNHHVPEQLMKYHTEASTTFIKIQVEDVDEPPLFLL
PYYVFEVFEETPQGSFVGVVSATDPDNRKSPIRYSITRSKVFNINDNGTITTSNSLDREISA
WYNLSITATEKYNIEQISSIPLYVQVLNINDHAPEFSQYYETYVCENAGSGQVIQTISAVDR
DESIEEHHFYFNLSVEDTNNSSFTIIDNQDNTAVILTNRTGFNLQEEPVFYISILIADNGIP
SLTSTNTLTIHVCDCGDSGSTQTCQYQELVLSMGFKTEVIIAILICIMIIFGFIFLTLGLKQ
RRKQILFPEKSEDFRENIFQYDDEGGGEEDTEAFDIAELRSSTIMRERKTRKTTSAEIRSLY
RQSLQVGPDSAIFRKFILEKLEEANTDPCAPPFDSLQTYAFEGTGSLAGSLSSLESAVSDQD
ESYDYLNELGPRFKRLACMFGSAVQSNN

Important features:
Signal peptide:
amino acids 1-21

Transmembrane domain:
amino acids 597-617

N-glycosylation sites.
amino acids 57-60, 74-77, 419-423, 437-440, 508-511, 515-518, 516-519 and 534-537

Cadherins extracellular repeated domain signature.
amino acids 136-146 and 244-254

FIGURE 96

ATTTCAAGGCCAGCCATATTTTTNTGTTGAACCAACAACAGGAGTCATAAGAATATTTTNTA
AAATGGATAGAGAACTGCAAGATGAGTATTGGGTAATCATTCAAGCCAAGGACATGATTGGT
CAGCCAGGAGCGTTGTNTGGAACAACAAGTGTATTAATTAAACTTTCAGATGTTAATGACAA
TAAGCCTATATTTAAAGAAAGTTTATACCGCTTGACTGTNTNTGAATCTGCACCCACTGGGA
NTTNTATAGGAACAATCATGGCATATGATAATGACATAGGAGAGAATGCAGAAATGGATTAC
AGCATTGAAGAGGATGATTCGCAAACATTTGACATTATT

FIGURE 97

```
GCAACCTCAGCTTCTAGTATCCAGACTCCAGCGCCGCCCCGGGCGCGGACCCCAACCCCGAC
CCAGAGCTTCTCCAGCGGCGGCGCAGCGAGCAGGGCTCCCCGCCTTAACTTCCTCCGCGGGG
CCCAGCCACCTTCGGGAGTCCGGGTTGCCCACCTGCAAACTCTCCGCCTTCTGCACCTGCCA
CCCCTGAGCCAGCGCGGGCCCCCGAGCGAGTCATGGCCAACGCGGGGCTGCAGCTGTTGGGC
TTCATTCTCGCCTTCCTGGGATGGATCGGCGCCATCGTCAGCACTGCCCTGCCCCAGTGGAG
GATTTACTCCTATGCCGGCGACAACATCGTGACCGCCCAGGCCATGTACGAGGGCTGTGGA
TGTCCTGCGTGTCGCAGAGCACCGGGCAGATCCAGTGCAAAGTCTTTGACTCCTTGCTGAAT
CTGAGCAGCACATTGCAAGCAACCCGTGCCTTGATGGTGGTTGGCATCCTCCTGGGAGTGAT
AGCAATCTTTGTGGCCACCGTTGGCATGAAGTGTATGAAGTGCTTGGAAGACGATGAGGTGC
AGAAGATGAGGATGGCTGTCATTGGGGGTGCGATATTTCTTCTTGCAGGTCTGGCTATTTTA
GTTGCCACAGCATGGTATGGCAATAGAATCGTTCAAGAATTCTATGACCCTATGACCCCAGT
CAATGCCAGGTACGAATTTGGTCAGGCTCTCTTCACTGGCTGGGCTGCTGCTTCTCTCTGCC
TTCTGGGAGGTGCCCTACTTTGCTGTTCCTGTCCCGAAAAACAACCTCTTACCCAACACCA
AGGCCCTATCCAAAACCTGCACCTTCCAGCGGGAAGACTACGTGTGACACAGAGGCAAAAG
GAGAAAATCATGTTGAAACAAACCGAAAATGGACATTGAGATACTATCATTAACATTAGGAC
CTTAGAATTTTGGGTATTGTAATCTGAAGTATGGTATTACAAAACAAACAAACAAACAAAAA
ACCCATGTGTTAAAATACTCAGTGCTAAACATGGCTTAATCTTATTTTATCTTCTTTCCTCA
ATATAGGAGGGAAGATTTTTCCATTTGTATTACTGCTTCCCATTGAGTAATCATACTCAAAT
GGGGGAAGGGGTGCTCCTTAAATATATATAGATATGTATATATACATGTTTTTCTATTAAAA
ATAGACAGTAAAATACTATTCTCATTATGTTGATACTAGCATACTTAAAATATCTCTAAAAT
AGGTAAATGTATTTAATTCCATATTGATGAAGATGTTTATTGGTATATTTTCTTTTTCGTCC
TTATATACATATGTAACAGTCAAATATCATTTACTCTTCTTCATTAGCTTTGGGTGCCTTTG
CCACAAGACCTAGCCTAATTTACCAAGGATGAATTCTTTCAATTCTTCATGCGTGCCCTTTT
CATATACTTATTTTATTTTTTACCATAATCTTATAGCACTTGCATCGTTATTAAGCCCTTAT
TTGTTTTGTGTTTCATTGGTCTCTATCTCCTGAATCTAACACATTTCATAGCCTACATTTTA
GTTTCTAAAGCCAAGAAGAATTTATTACAAATCAGAACTTTGGAGGCAAATCTTTCTGCATG
ACCAAAGTGATAAATTCCTGTTGACCTTCCCACACAATCCCTGTACTCTGACCCATAGCACT
CTTGTTTGCTTTGAAAATATTTGTCCAATTGAGTAGCTGCATGCTGTTCCCCAGGTGTTGT
AACACAACTTTATTGATTGAATTTTAAGCTACTTATTCATAGTTTTATATCCCCTAAACT
ACCTTTTTGTTCCCCATTCCTTAATTGTATTGTTTTCCCAAGTGTAATTATCATGCGTTTTA
TATCTTCCTAATAAGGTGTGGTCTGTTTGTCTGAACAAAGTGCTAGACTTTCTGGAGTGATA
ATCTGGTGACAAATATTCTCTCTGTAGCTGTAAGCAAGTCACTTAATCTTTCTACCTCTTTT
TTCTATCTGCCAAATTGAGATAATGATACTTAACCAGTTAGAAGAGGTAGTGTGAATATTAA
TTAGTTTATATTACTCTTATTCTTTGAACATGAACTATGCCTATGTAGTGTCTTTATTTGCT
CAGCTGGCTGAGACACTGAAGAAGTCACTGAACAAAACCTACACACGTACCTTCATGTGATT
CACTGCCTTCCTCTCTCTACCAGTCTATTTCCACTGAACAAAACCTACACATACCTTCAT
GTGGTTCAGTGCCTTCCTCTCTCTACCAGTCTATTTCCACTGAACAAAACCTACGCACATAC
CTTCATGTGGCTCAGTGCCTTCCTCTCTCTACCAGTCTATTTCCATTCTTTCAGCTGTGTCT
GACATGTTTGTGCTCTGTTCCATTTTAACAACTGCTCTTACTTTTCCAGTCTGTACAGAATG
CTATTTCACTTGAGCAAGATGATGTAATGGAAGGGTGTTGGCACTGGTGTCTGGAGACCTG
GATTTGAGTCTTGGTGCTATCAATCACCGTCTGTGTTTGAGCAAGGCATTTGGCTGCTGTAA
GCTTATTGCTTCATCTGTAAGCGGTGGTTTGTAATTCCTGATCTTCCCACCTCACAGTGATG
TTGTGGGGATCCAGTGAGATAGAATACATGTAAGTGTGGTTTTGTAATTTAAAAGTGCTAT
ACTAAGGGAAAGAATTGAGGAATTAACTGCATACGTTTTGGTGTTGCTTTTCAAATGTTTGA
AAATAAAAAAAATGTTAAG
```

FIGURE 98

></usr/seqdb2/sst/DNA/Dnaseqs.min/ss.DNA52185
><subunit 1 of 1, 211 aa, 1 stop
><MW: 22744, pI: 8.51, NX(S/T): 1
MANAGLQLLGFILAFLGWIGAIVSTALPQWRIYSYAGDNIVTAQAMYEGLWMSCVSQSTGQI
QCKVFDSLLNLSSTLQATRALMVVGILLGVIAIFVATVGMKCMKCLEDDEVQKMRMAVIGGA
IFLLAGLAILVATAWYGNRIVQEFYDPMTPVNARYEFGQALFTGWAAASLCLLGGALLCCSC
PRKTTSYPTPRPYPKPAPSSGKDYV Important features:

Signal peptide:

amino acids 1-21

Transmembrane domains:

amino acids 82-102, 118-142 and 161-187

N-glycosylation site.

amino acids 72-75

PMP-22 / EMP / MP20 family proteins amino acids 70-111

ABC-2 type transport system integral membrane protein amino acids 119-133

FIGURE 99

TTCTGGCCAAACCCGGGGCTNCAGCTGTTGGGCTTCATCTCGCCTTCCTGGGATGGATCGGC
GCCATCNTCACACTGCCCTTCCCCAGTGGAGGATTTTACTCCCTATGCTGGCGACAACATCG
TGACCGCCCAGCCCATGTACGAGGGGCTGTGGATGTCCNGCGTGTCGCAGAGCACCGGGCAG
ATCCAGTGCAAAGTCTTTGACTCCTTGCTGAATCTGAGCAGCACATTGCAAGCAACCCGTGC
CTTGATGGTGGTTGGCATCCTCCTGGGAGTGATAGCAATCTTTGTGGCCACCGTTGGCATGA
AGTGTATGAAGTGCTTGGAAGACGATGAGGTGCAGAAGATGAGGATGGCTGTCATTGGGGGC
GCGATATTTCTTCTTGCAGGTCTGGCTATTTTAGTTGCCACAGCATGGTATGGCAATAGAAN
CNTTCAACANTTCTATGACCCTATGACCCCAGTCAATGCCAGGTACGAATTTGGTCA
GGCTCTCTTCACTGGCTGGGCTGCTGCTTCTCTCTGCCTTCTGGGAGGTGCCCTACTTTGCT
GTTCCTGTCCC

FIGURE 100

ACCCTTGACCCAACGCGGCCCCCCGACCGNTTCATGGCCAAACGCGGGNCTCCAGCTGTTGG
GCTTCATTCTCCCCTTCCTGGGATGGACCGGCGCCCATCNTCAGCACTGCCCTGCCCCAGTG
GAGGATTTACTCCTATNCCGGCNACAACATCGTGACCGCCCAGGCCNTGTACGAGGGGCTGT
GGATGTCCTGCGTGTCGCAGAGCACCGGGCAGATCCAGTGCAAAGTCTTTGACTCCCTTGCT
GAATCTGAGCAGCACATTGCAAGCAACCCGTGCCTTGATGGTGGTTGGCATCCTCCTGGGAG
TGATAGCAATCTTNNTGGCCACCGTTGTNNNTGAAGTGTATGAAGTGCTTGGAAGACGATGA
GGTGCAGAAGATGAGGATGGCTGTCATTGGGGGCGCGATATTTCTTCTTGCAGGTCTGGCTA
TTTTAGTTGCCACAGCATGGTATGGCAATAGAATCGTTCAAGAATTCTATGACCCTATGACCGA

FIGURE 101

```
GGGCCCGACCATTATCCAACCGGGNTCACTGTTGGCTCATCTCCCTCCTGGATGAANCGCGC
CATCNTCAGACTCCCTGCCCCATGGAGATTTNNCCTATGCTGGCGACAACATCNTGACCCCC
AGCCATGTACGAGGGGCTTTGAACGTCNGCGTGTCGCAGANCACCGGGCAGATCCAGTGCAA
AGTCTTTGACTCCTTGCTGAATCTGNGCAGCACATTGCAGCAACCCNTGCCCTGATGGTGGT
TGGCATCCTCCTGGGAGTGATAGCAATCTTTGTGGCCACCGTTGGCATGAAGTGTATGAAGT
GCTTGGAAGACGATGAGGTGCAGAAGATGAGGATGGCTGTCATTGGGGGCGCGATATTTCTT
CTTGCAGGTCTGGCTATTTNNNGTTGCCACAGCATGGTATGGCAATAGAATCGTTCAAGAAT
TCTATGACCCTATGACCCCAGTCAATGCCAGGTACGAATTTGGTCAGGCTCTCTTCACTGGC
TGGGCTGCTGCTTCTCTCTGCCTTCTGGGAGGTGCCCTACTTTGCTGTTCCTGCGA
```

FIGURE 102

ATTCTCCCCTCCTGGATGGATCGCNCCACCGTCACATTGCCTTCCCCCANTGGAGGATTNAC
TCCTATGCTGGCGACAACATCGTGACCCCCCAGGCCATTTACCGAGGGGCTTTGGATGTCNT
GCNTGTCGCAGAGCACCGGGCAGATCCCAGTGCAAAGTCTTTGACTCCTTGCTGAATCTGAG
CAGCACATTGCAAGCAACCCGTGCCTTGATGGGGTTGGCATCCTCCTGGGAGTGATAGCAAC
CTTTGTGGCCACCGTTGGCATGAAGTGTATGAAGTGCTTGGAAGACGATGAGGTGCCAGAAG
ATGAGGATGGCTGTCATTGGGGCGCGATATTTCTTGTTGCAGGTCTGGCTATTTTAGTNGC
CACAGCATGGTATGGCAATAGANTNNTTCNNGNNNTCTATGACCCTATGACCCCAGTCAATG
CCAGGTACGAATTTGGTCAGGCTCTCTTCACTGGCTGGGCTGCTGCTTCTCTCTGCCTTCTG
GGAGGTGCCCTACTTTGCTGTTCCTGTCCC

FIGURE 103

AGAGCACCGGCAGATCCCAGTNCAAAGTCTTTGACCCTTGCTGAATCTGAGCAGCACATTNC
AAGCAACCCCTTGCCTTGAAGGTGGTTGNCATCCCCCCTGGGAGTGAATAGCAATCTTTGTG
GCCACCGTTGGCATGAAGTNTATGAAGTGCTTGGAAGACGATGAGGTGCAGAAGATGAGGAT
GGCTGTCATTGGGGGCGCGATATTTCTTCTTGCAGGTCTGGCTATTTTAGTNNCCACAGCAT
GGTATGGCAATAGNATNNTTCGNGGNTTCTATGACCCTATGACCCCAGTCAATGCCAGGTAC
GAATTTGGTCAGGCTCTCTTCACTGGCTGGGCTGCTGCTTCTCTCTGCCTTCTGGGAGGTGC
CCTACTTTGCTGTTCCTGTCCCCGAA

FIGURE 104

```
AGCAATGCCCTGCCCCCAGTGGAGGATTAATTCCTATGNTGGGGACAACATTGTGACNGCCC
AGGCCATGTACGGGGGGCTGTGGATGTCCTGCGTGTCGCAGAGCACCGGGCAGATCCAGTGC
AAAGTNTTTGACTCCTTGCTGAATTTGAGCAGCACATTGCAAGCAACCCGTGCCTTGATGGT
GGTTGGCATCTTCCTGGGAGTGATAGCAATCTTTGTGGCCACCGTGGNAATGAAGTGTATGA
AGTGCTTGGAAGACGATGAGGTGCAGAAGATGAGGATGGCTGTCATTGGGGGCGCGATATTT
CTTNTTGCAGGTCTGGCTATTTTAGTTGCCACAGCATGGTATGGCAATAGAATNGTTCAAGA
ATTTTATGACCCTATGACCCCAGTCAATGCCAGGTACGAATTTGGTCAGGCTTTNTTCACTG
GCTGGGCTGCTGCTTNTTTCTGCCTTNTGGGAGGTGCCCTANTTTGCTGTTCCTGCGAACC
```

FIGURE 105

TCATAGGGGGGCGCGATATTTTTTCTTGCAGGTNTGGTTATTTTAGTTGCCACAGCATGGTA

TGGCAATAGAATCGTTCAAGAATTNTATGACCCTATGACCCCAGTCAATGCCAGGTACGAAT

TTGGTCAGGCTCTNTTCACTGGNTGGGCTGCTGCTTCTNTNNGCCTTNTGGGAGGTGCCCTA

CTTTGCTGTTCCTG

FIGURE 106

```
TTCCTGGGATGGATCCGCCCCCATCNTCACATGCCCTGCCCCNTGGAGATTTACNCCTATGC
TGGCGAACAACATCNTGACCGCCCAGGCCATGTACGAGGGGCTGTGGAATGTCCTGCGTGTC
CCAGAGCACCGGGCAGATCCAGTGCAAAGTCTTTGACTCCTTGCTGAATCTGAGCAGCACAT
TGCAAGCAACCNTGCCTTGATGGTGGTTGGCATCCTCCTGGGAGTGATAGCAATCTTTGTGG
CCACCGTTGGCATGAAAGTGTATGAAGTGCTTGGAAGACGATGAGGTGCAGAAGATGAGGAT
GGCTGTCATTGGGGGCGCGATATTTCTTCTTGCAGGTCTGGCTATTTTAGNNGCCACAGCAT
GGTATGGCAATCAGACCCNNTCANAAACTCTATGACCCTATGACCCCAGTCAATGCCAGGTA
CGAATTTGGTCAGGCTCTCTTCACTGGCTGGGCTGCTGCTTCTCTGCCTTCTGGGAGGTG
CCCTACTTTGCTGTTCCTGTCCCCGAAAAACAACCTCTTACCCACG
```

FIGURE 107

CGGGGCTGCAGCTGTTGGGCTTCATCTCGCTTCCTGGGATGGAATCGGCGCCATCGTCAGCA
CTGCCCTGCCCCATGGAGGATTTACTCNTATGCTGGCGACAACATCGTGACCNCCCAGGCCA
TGTACGAGGGGCTGTGGATGTCNGCGTGTCGCAGAGCACCGGGCAGATCCAGTGCAAAGTCT
TTGACTCCTTGCTGAATCTGAGCAGCACATTGCAAGCAACCNTGCCTTGATGGTGGTTGGCA
TCCTCCTGGGAGTGATAGCAATCTTTGTGGCCACCGTTGGCATGAAGTGTATGAAGTGCTTG
GAAGACGATGAGGTGCAGAAGATGAGGATGGCTGTCATTGGGGCGCGATATTTCTTCTTGC
AGGTCTGGCTATTTNTAGTTGCCACAGCATGGTATGGCAATAGAATCGTTCAAGAATTCTAT
GACCCTATGACCCCAGTCAATGCCAGGTACGAATTTGGTCAGGCTCTCTTCACTGGCTGGGC
TGCTGCTTCTCTCTGCCTTCTGGGAGGTGCCCTACTTTGCTGTTCCTGCGAA

FIGURE 108

```
GCGTGCCGTCAGCTCGCCGGGCACCGCGGCCTCGCCCTCGCCCTCCGCCCCTGCGCCTGCAC
CGCGTAGACCGACCCCCCCTCCAGCGCGCCCACCCGGTAGAGGACCCCCGCCCGTGCCCCG
ACCGGTCCCCGCCTTTTTGTAAAACTTAAAGCGGGCGCAGCATTAACGCTTCCCGCCCCGGT
GACCTCTCAGGGGTCTCCCCGCCAAAGGTGCTCCGCCGCTAAGGAACATGGCGAAGGTGGAG
CAGGTCCTGAGCCTCGAGCCGCAGCACGAGCTCAAATTCCGAGGTCCCTTCACCGATGTTGT
CACCACCAACCTAAAGCTTGGCAACCCGACAGACCGAAATGTGTGTTTTAAGGTGAAGACTA
CAGCACCACGTAGGTACTGTGTGAGGCCCAACAGCGGAATCATCGATGCAGGGGCCTCAATT
AATGTATCTGTGATGTTACAGCCTTTCGATTATGATCCCAATGAGAAAAGTAAACACAAGTT
TATGGTTCAGTCTATGTTTGCTCCAACTGACACTTCAGATATGGAAGCAGTATGGAAGGAGG
CAAAACCGGAAGACCTTATGGATTCAAAACTTAGATGTGTGTTTGAATTGCCAGCAGAGAAT
GATAAACCACATGATGTAGAAATAAATAAAATTATATCCACAACTGCATCAAAGACAGAAAC
ACCAATAGTGTCTAAGTCTCTGAGTTCTTCTTTGGATGACACCGAAGTTAAGAAGGTTATGG
AAGAATGTAAGAGGCTGCAAGGTGAAGTTCAGAGGCTACGGGAGGAGAACAAGCAGTTCAAG
GAAGAAGATGGACTGCGGATGAGGAAGACAGTGCAGAGCAACAGCCCCATTTCAGCATTAGC
CCCAACTGGGAAGGAAGAAGGCCTTAGCACCCGGCTCTTGGCTCTGGTGGTTTTGTTCTTTA
TCGTTGGTGTAATTATTGGGAAGATTGCCTTGTAGAGGTAGCATGCACAGGATGGTAAATTG
GATTGGTGGATCCACCATATCATGGGATTTAAATTTATCATAACCATGTGTAAAAGAAATT
AATGTATGATGACATCTCACAGGTCTTGCCTTTAAATTACCCCTCCCTGCACACACATACAC
AGATACACACACACAAATATAATGTAACGATCTTTTAGAAAGTTAAAAATGTATAGTAACTG
ATTGAGGGGAAAAAGAATGATCTTTATTAATGACAAGGGAAACCATGAGTAATGCCACAAT
GGCATATTGTAAATGTCATTTTAAACATTGGTAGGCCTTGGTACATGATGCTGGATTACCTC
TCTTAAAATGACACCCTTCCTCGCCTGTTGGTGCTGGCCCTTGGGGAGCTGGAGCCCAGCAT
GCTGGGGAGTGCGGTCAGCTCCACACAGTAGTCCCCACGTGGCCCACTCCCGGCCCAGGCTG
CTTTCCGTGTCTTCAGTTCTGTCCAAGCCATCAGCTCCTTGGGACTGATGAACAGAGTCAGA
AGCCCAAAGGAATTGCACTGTGGCAGCATCAGACGTACTCGTCATAAGTGAGAGGCGTGTGT
TGACTGATTGACCCAGCGCTTTGGAAATAAATGGCAGTGCTTTGTTCACTTAAAGGGACCAA
GCTAAATTTGTATTGGTTCATGTAGTGAAGTCAAACTGTTATTCAGAGATGTTTAATGCATA
TTTAACTTATTTAATGTATTTCATCTCATGTTTTCTTATTGTCACAAGAGTACAGTTAATGC
TGCGTGCTGCTGAACTCTGTTGGGTGAACTGGTATTGCTGCTGGAGGGCTGTGGGCTCCTCT
GTCTCTGGAGAGTCTGGTCATGTGGAGGTGGGGTTTATTGGGATGCTGGAGAAGAGCTGCCA
GGAAGTGTTTTTTCTGGGTCAGTAAATAACAACTGTCATAGGGAGGGAAATTCTCAGTAGTG
ACAGTCAACTCTAGGTTACCTTTTTTAATGAAGAGTAGTCAGTCTTCTAGATTGTTCTTATA
CCACCTCTCAACCATTACTCACACTTCCAGCGCCCAGGTCCAAGTCTGAGCCTGACCTCCCC
TTGGGGACCTAGCCTGGAGTCAGGACAAATGGATCGGGCTGCAGAGGGTTAGAAGCGAGGGC
ACCAGCAGTTGTGGGTGGGGAGCAAGGGAAGAGAGAAACTCTTCAGCGAATCCTTCTAGTAC
TAGTTGAGAGTTTGACTGTGAATTAATTTTATGCCATAAAAGACCAACCCAGTTCTGTTTGA
CTATGTAGCATCTTGAAAAGAAAAATTATAATAAAGCCCCAAAATTAAGAAAA
```

FIGURE 109

```
</usr/seqdb2/sst/DNA/Dnaseqs.min/ss.DNA53977
<subunit 1 of 1, 243 aa, 1 stop
<MW: 27228, pI: 7.43, NX(S/T): 2
MAKVEQVLSLEPQHELKFRGPFTDVVTTNLKLGNPTDRNVCFKVKTTAPRRYCVRPNSGIID
AGASINVSVMLQPFDYDPNEKSKHKFMVQSMFAPTDTSDMEAVWKEAKPEDLMDSKLRCVFE
LPAENDKPHDVEINKIISTTASKTETPIVSKSLSSSLDDTEVKKVMEECKRLQGEVQRLREE
NKQFKEEDGLRMRKTVQSNSPISALAPTGKEEGLSTRLLALVVLFFIVGVIIGKIAL
```

Important features:

Transmembrane domain:

amino acids 224-239

N-glycosylation site.

amino acids 68-71

N-myristoylation site.

amino acids 59-64, 64-69 and 235-240

FIGURE 110

GTCAGTCTTCTAGATTGTCCTTATCCCACCTTTCAACCANTACTCACATTTCNAGCGCCCAG
GTCCANGTCTGAGCCTGACTTCCCCTTGGGGACCTAGCCTGGAGTCAGGACAATGGNTCGGG
CTGCAGAGGNTTAGAAGCGAGGGCACCAGCAGTTTTGGGTGGGGAGCAAGGGNNGAGAGAAA
CTCTTCAGCGAATCCTTCTAGTACTAGTTGAGAGTTTGACTGTGAATTAATTTTATGCCATA
AAAGACNAACCCAGTTCTGTTTGACTATGTAGCATCTTGAAAAGAAAAATTATAATAAAGCC
CCAAAATTAAGAATTCTTTTGTCATTTTGTCACATTTGCTCTATGGGGGAATTATTATTTT
ATCATTTTATTATTTTGCCATTGGAAGGTTAACTTTAAAATGAGC

FIGURE 111

TATTGTAAAGGCCATTTTAAACCATTGGTAGGCCTTGGTACATGATGCTGGATTACCTCCTT
AAATGACACCNTTCCTCGCCTGTTGGTGCTGGCCNTTGGGGAGCTGGAGCCCCAGCATGCTG
GGGAGTGCGGTCAGCTCCACACAGTAGTCCCCACGTGGCCCACTCCCGGCCCAGGCTGCTTT
CCGTGTCTTCAGTTCTGTCCAAGCCATCAGCTCCTTGGGACTGATGAACAGAGTCAGAAGCC
CAAAGGAATTGCCACTGTGGCAGCATCAGACGTACTCGTCATAAGTGAGAGGCGTGTGTTGA
CTGATTGACCCAGCGCTTTGGAAATAAATGGCAGTGCTTTGTTCACTTAAAGGGACCAAGCT
AAATTGTATTGGTTCATGTAGTGAAGTCAAACTGTTATTCAGAGATGTTTAATGCATATTTA
ACTTATTTAATGTATTTCATCTCATGTTTTCTTATTGTCACAAGAGTACAGTTAATGCTGCG
TGCTGCTGAACTCTGTTGGGTGAACTGGTATTGCTGCTGGAGGGCTG

FIGURE 112

CCCTGGTGGTTTTGTTCTTTAATTCGTTGGTGTAATTNTTGGGAAGATTGCTTGTAGAGGTA
GNATGCACCNGGCTGGTAAATTGGATTGGTGGATCCACCATATCCATGGGATTTAAATTTAT
CATAACCATGTGTAAAAAGAAATTAATGTATGATGACATNTCACAGGTATTGCCTTTAAATT
ACCCATCCCTGNANACACATACACAGATACACANANACAAATNTAATGTAACGATNTTTTAG
AAAGTTAAAAATGTATAGTAAC

FIGURE 113

GGTGGCCCATTCCCGGCCCAGGCTGCTTTCCGGTNTTCAGTTCTGTCCAAGCCATCAGCTCC
TTGGGACTGATGAACAGAGTCAGAAGCCCAAAGGAATTGCACTGTGGCAGCATNAGACGTAC
TTGTNATAAGTGAGAGGCGTGTGTTGACTGATTGACCCAGCGCTTTGGAAATAAATGGCAGT
GCTTTGTTCANTTAAAGGGACCAAGCTAAATTTGTATTGGTTCATGTAGTGAAGTCAAACTG
TTATTCAGAGATGTTTAATGCATATTTAANTTATTTAATGTATTTNATNTCATGTTTTCTTA
TTGTCACAAGAGTACAGTTAATGCTGCGTGCTGCTGAANTNTGTTGGGTGAACTGGTATTGC
TGCTGGAGGGCTGTGGGCTCCTCTGTCTTTGGAGAGTCTGGTCATGTGGAGGTGGG

FIGURE 114

TGCTTTCCGTGTCTTCAGTTCTGTCCAAGCCATCAGCTCCTTGGGACTTGATGAACAGAGTC
AGAAGCCCAAAGGAATTGCACTGTGGCAGCATCAGACGTACTCGTCATAAGTGAGAGGCGTG
TGTTGACTGATTGACCCAGCGCTTTGGAAATAAATGGCAGTGCTTTGTTCACTTAAAGGGAC
CAAGCTAAATTTGTATTGGTTCATGTAGTGAAGTCAAACTGTTATTCAGAGATGTTTAATGC
ATATTTAACTTATTTAATGTATTTCATCTCATGTTTTCTTATTGTCACAAGAGTACAGTTAA
TGCTGCGTGC

FIGURE 115

```
AAACCTTTAAAAGTTGAGGGGAAAAGAATGATCCTTTATTAATGACAAGGGAAACCNTGNGT
AATGCCACAATGGCATATTGTAAATGTCATTTTAAACATTGGTAGGCCTTGGTACATGATGC
TGGATTACCTCTCTTAAAATGACACCCTTCCTCGCCTGTTGGTGCTGGCCCTTGGGGAGCTN
GAGCCCAGCATGCTGGGGAGTGCGGTCTGCTCCACACAGTAGTCCCCANGTGGCCCANTCCC
GGCCCAGGCTGCTTTCCGTGTCTTCAGTTCTGTCCAAGCCATCAGCTCCTTGGGANTGATGA
ACAGAGTCAGAAGCCCAAAGGAATTGCANTGTGGCAGCATCAGANGTANTNGTCATAAGTGA
GAGGCGTGTGTTGANTGATTGACCCAGCGCTTTGGAAATAAATGGCAGTGCTTTGTTCANTT
AAAGGGNCCAAGNTAAATTTGTATTGGTTCATGTAGTGAAGTCAAANTGTTATTCAGAGATG
TTTAATGCATATTTAANTTATTTAATGTATTTCATNTCATGTTTTCTTATTGTCACAAGGGT
ACAGTTAATGCTGCGTGCTGCTGAANTCTGTTGGGTGAANTGGTATTGCTG
```

FIGURE 116

```
GGCCCTTGGGGAGCTGGAGCCCAGCATGCTGGGGAGTGCGGTCAGCTCCACACAGTAGTCCC
CACGTGGCCCACTCCCGGCCCAGGCTGCTTTCCGTGTCTTCAGTTCTGTCCAAGCCATCAGC
TCCTTGGGACTGATGAACAGAGTCAGAAGCCCAAAGGAATTGCACTGTGGCAGCATCAGACG
TACTCGTCATAAGTGAGAGGCGTGTGTTGACTGATTGACCCAGCGCTTTGGAAATAAATGGC
AGTGCTTTGTTCACTTAAAGGGACCAAGCTAAATTTGTATTGGTTCATGTAGTGAAGTCAAA
CTGTTATTCAGAGATGTTTAATGCATATTTAACTTATTTAATGTATTTCATCTCATGTTTTC
TTATTGTCACAAGAGTACAGTTAATGCTGCGTGCTGCTGAACTCTGTTGGGTGAACTGGTAT
TGCTGCTGGAGGGCTGTGGGCTCCTCTGTCTCTGGAGAGTCTGGTCATGTGGAGGTGGG
```

FIGURE 117

```
GCGAGCTCCGGGTGCTGTGGCCCGGCCTTGGCGGGCGGCCTCCGGCTCAGGCTGGCTGAGA
GGCTCCCAGCTGCAGCGTCCCCGCCCGCCTCCTCGGGAGCTCTGATCTCAGCTGACAGTGCC
CTCGGGGACCAAACAAGCCTGGCAGGGTCTCACTTTGTTGCCCAGGCTGGAGTTCAGTGCCA
TGATCATGGTTTACTGCAGCCTTGACCTCCTGGGTTCAAGCGATCCTGCTGAGTAGCTGGGA
CTACAGGACAAAATTAGAAGATCAAAATGGAAAATATGCTGCTTTGGTTGATATTTTTCACC
CCTGGGTGGACCCTCATTGATGGATCTGAAATGGAATGGGATTTTATGTGGCACTTGAGAAA
GGTACCCCGGATTGTCAGTGAAGGACTTTCCATCTCACCAGCCCCGCATTTGAGGCAGATG
CTAAGATGATGGTAAATACAGTGTGTGGCATCGAATGCCAGAAAGAACTCCCAACTCCCAGC
CTTTCTGAATTGGAGGATTATCTTTCCTATGAGACTGTCTTTGAGAATGGCACCCGAACCTT
AACCAGGGTGAAAGTTCAAGATTTGGTTCTTGAGCCGACTCAAAATATCACCACAAAGGGAG
TATCTGTTAGGAGAAAGAGACAGGTGTATGGCACCGACAGCAGGTTCAGCATCTTGGACAAA
AGGTTCTTAACCAATTTCCCTTTCAGCACAGCTGTGAAGCTTTCCACGGGCTGTAGTGGCAT
TCTCATTTCCCCTCAGCATGTTCTAACTGCTGCCCACTGTGTTCATGATGGAAAGGACTATG
TCAAAGGGAGTAAAAAGCTAAGGGTAGGGTTGTTGAAGATGAGGAATAAAAGTGGAGGCAAG
AAACGTCGAGGTTCTAAGAGGAGCAGGAGAGAAGCTAGTGGTGGTGACCAAAGAGAGGGTAC
CAGAGAGCATCTGCAGGAGAGAGCGAAGGGTGGGAGAAGAAGAAAAAAATCTGGCCGGGGTC
AGAGGATTGCCGAAGGGAGGCCTTCCTTTCAGTGGACCCGGGTCAAGAATACCCACATTCCG
AAGGGCTGGGCACGAGGAGGCATGGGGACGCTACCTTGGACTATGACTATGCTCTTCTGGA
GCTGAAGCGTGCTCACAAAAGAAATACATGGAACTTGGAATCAGCCCAACGATCAAGAAAA
TGCCTGGTGGAATGATCCACTTCTCAGGATTTGATAACGATAGGGCTGATCAGTTGGTCTAT
CGGTTTTGCAGTGTGTCCGACGAATCCAATGATCTCCTTTACCAATACTGCGATGCTGAGTC
GGGCTCCACCGGTTCGGGGGTCTATCTGCGTCTGAAAGATCCAGACAAAAGAATTGGAAGC
GCAAAATCATTGCGGTCTACTCAGGGCACCAGTGGGTGGATGTCCACGGGGTTCAGAAGGAC
TACAACGTTGCTGTTCGCATCACTCCCCTAAAATACGCCCAGATTTGCCTCTGGATTCACGG
GAACGATGCCAATTGTGCTTACGGCTAACAGAGACCTGAAACAGGGCGGTGTATCATCTAAA
TCACAGAGAAACCAGCTCTGCTTACCGTAGTGAGATCACTTCATAGGTTATGCCTGGACTT
GAACTCTGTCAATAGCATTTCAACATTTTTCAAAATCAGGAGATTTTCGTCCATTTAAAAAA
TGTATAGGTGCAGATATTGAAACTAGGTGGGCACTTCAATGCCAAGTATATACTCTTCTTTA
CATGGTGATGAGTTTCATTTGTAGAAAATTTGTTGCCTTCTTAAAAATTAGACACACTTT
AAACCTTCAAACAGGTATTATAAATAACATGTGACTCCTTAATGGACTTATTCTCAGGGTCC
TACTCTAAGAAGAATCTAATAGGATGCTGGTTGTGTATTAAATGTGAATTGCATAGATAAA
GGTAGATGGTAAAGCAATTAGTATCAGAATAGAGACAGAAAGTTACAACACAGTTTGTACTA
CTCTGAGATGGATCCATTCAGCTCATGCCCTCAATGTTTATATTGTGTTATCTGTTGGGTCT
GGGACATTTAGTTTAGTTTTTTTGAAGAATTACAAATCAGAAGAAAAGCAAGCATTATAAA
CAAAACTAATAACTGTTTTACTGCTTTAAGAAATAACAATTACAATGTGTATTATTTAAAAA
TGGGAGAAATAGTTTGTTCTATGAAATAAACCTAGTTTAGAAATAGGGAAGCTGAGACATTT
TAAGATCTCAAGTTTTTATTTAACTAATACTCAAAATATGGACTTTTCATGTATGCATAGGG
AAGACACTTCACAAATTATGAATGATCATGTGTTGAAAGCCACATTATTTTATGCTATACAT
TCTATGTATGAGGTGCTACATTTTTAGGACAAAGAATTCTGTAATCTTTTTCAAGAAAGAGT
CTTTTTCTCCTTGACAAAATCCAGCTTTTGTATGAGGACTATAGGGTGAATTCTCTGATTAG
TAATTTTAGATATGTCCTTTCCTAAAAATGAATAAAATTTATGAATATGA
```

FIGURE 118

</usr/seqdb2/sst/DNA/Dnaseqs.min/ss.DNA57253
<subunit 1 of 1, 413 aa, 1 stop
<MW: 47070, pI: 9.92, NX(S/T): 3
MENMLLWLIFFTPGWTLIDGSEMEWDFMWHLRKVPRIVSERTFHLTSPAFEADAKMMVNTVC
GIECQKELPTPSLSELEDYLSYETVFENGTRTLTRVKVQDLVLEPTQNITTKGVSVRRKRQV
YGTDSRFSILDKRFLTNFPFSTAVKLSTGCSGILISPQHVLTAAHCVHDGKDYVKGSKKLRV
GLLKMRNKSGGKKRRGSKRSRREASGGDQREGTREHLQERAKGGRRRKKSGRGQRIAEGRPS
FQWTRVKNTHIPKGWARGGMGDATLDYDYALLELKRAHKKKYMELGISPTIKKMPGGMIHFS
GFDNDRADQLVYRFCSVSDESNDLLYQYCDAESGSTGSGVYLRLKDPDKKNWKRKIIAVYSG
HQWVDVHGVQKDYNVAVRITPLKYAQICLWIHGNDANCAYG

Important features:
Signal peptide:
amino acids 1-16

N-glycosylation sites.
amino acids 90-93, 110-113 and 193-196

Glycosaminoglycan attachment site.
amino acids 236-239

Serine proteases, trypsin family, histidine active site.
amino acids 165-170

FIGURE 119

AATGTGAGAGGGGCTGATGGAAGCTGATAGGCAGGACTGGAGTGTTAGCACCAGTACTGGAT
GTGACAGCAGGCAGAGGAGCACTTAGCAGCTTATTCAGTGTCCGATTCTGATTCCGGCAAGG
ATCCAAGCATGGAATGCTGCCGTCGGGCAACTCCTGGCACACTGCTCCTCTTTCTGGCTTTC
CTGCTCCTGAGTTCCAGGACCGCACGCTCCGAGGAGGACCGGGACGGCCTATGGGATGCCTG
GGGCCCATGGAGTGAATGCTCACGCACCTGCGGGGAGGGGCCTCCTACTCTCTGAGGCGCT
GCCTGAGCAGCAAGAGCTGTGAAGGAAGAAATATCCGATACAGAACATGCAGTAATGTGGAC
TGCCCACCAGAAGCAGGTGATTTCCGAGCTCAGCAATGCTCAGCTCATAATGATGTCAAGCA
CCATGGCCAGTTTTATGAATGGCTTCCTGTGTCTAATGACCCTGACAACCCATGTTCACTCA
AGTGCCAAGCCAAAGGAACAACCCTGGTTGTTGAACTAGCACCTAAGGTCTTAGATGGTACG
CGTTGCTATACAGAATCTTTGGATATGTGCATCAGTGGTTTATGCCAAATTGTTGGCTGCGA
TCACCAGCTGGGAAGCACCGTCAAGGAAGATAACTGTGGGGTCTGCAACGGAGATGGGTCCA
CCTGCCGGCTGGTCCGAGGGCAGTATAAATCCCAGCTCTCCGCAACCAAATCGGATGATACT
GTGGTTGCACTTCCCTATGGAAGTAGACATATTCGCCTTGTCTTAAAAGGTCCTGATCACTT
ATATCTGGAAACCAAAACCCTCCAGGGGACTAAAGGTGAAAACAGTCTCAGCTCCACAGGAA
CTTTCCTTGTGGACAATTCTAGTGTGGACTTCCAGAAATTTCCAGACAAAGAGATACTGAGA
ATGGCTGGACCACTCACAGCAGATTTCATTGTCAAGATTCGTAACTCGGGCTCCGCTGACAG
TACAGTCCAGTTCATCTTCTATCAACCCATCATCCACCGATGGAGGGAGACGGATTTCTTTC
CTTGCTCAGCAACCTGTGGAGGAGGTTATCAGCTGACATCGGCTGAGTGCTACGATCTGAGG
AGCAACCGTGTGGTTGCTGACCAATACTGTCACTATTACCCAGAGAACATCAAACCCAAACC
CAAGCTTCAGGAGTGCAACTTGGATCCTTGTCCAGCCAGTGACGGATACAAGCAGATCATGC
CTTATGACCTCTACCATCCCCTTCCTCGGTGGGAGGCCACCCCATGGACCGCGTGCTCCTCC
TCGTGTGGGGGGGCATCCAGAGCCGGGCAGTTTCCTGTGTGGAGGAGGACATCCAGGGGCA
TGTCACTTCAGTGGAAGAGTGGAAATGCATGTACACCCCTAAGATGCCCATCGCGCAGCCCT
GCAACATTTTTGACTGCCCTAAATGGCTGGCACAGGAGTGGTCTCCGTGCACAGTGACATGT
GGCCAGGGCCTCAGATACCGTGTGGTCCTCTGCATCGACCATCGAGGAATGCACACAGGAGG
CTGTAGCCCAAAAACAAAGCCCCACATAAAAGAGGAATGCATCGTACCCACTCCCTGCTATA
AACCCAAAGAGAAACTTCCAGTCGAGGCCAAGTTGCCATGGTTCAAACAAGCTCAAGAGCTA
GAAGAAGGAGCTGCTGTGTCAGAGGAGCCCTCGTAAGTTGTAAAAGCACAGACTGTTCTATA
TTTGAAACTGTTTTGTTTAAAGAAAGCAGTGTCTCACTGGTTGTAGCTTTCATGGGTTCTGA
ACTAAGTGTAATCATCTCACCAAAGCTTTTTGGCTCTCAAATTAAAGATTGATTAGTTTCAA
AAAAAAAA

FIGURE 120

```
</usr/seqdb2/sst/DNA/Dnaseqs.min/ss.DNA58847
<subunit 1 of 1, 525 aa, 1 stop
<MW: 58416, pI: 6.62, NX(S/T): 1
MECCRRATPGTLLLFLAFLLLSSRTARSEEDRDGLWDAWGPWSECSRTCGGGASYSLRRCLS
SKSCEGRNIRYRTCSNVDCPPEAGDFRAQQCSAHNDVKHHGQFYEWLPVSNDPDNPCSLKCQ
AKGTTLVVELAPKVLDGTRCYTESLDMCISGLCQIVGCDHQLGSTVKEDNCGVCNGDGSTCR
LVRGQYKSQLSATKSDDTVVALPYGSRHIRLVLKGPDHLYLETKTLQGTKGENSLSSTGTFL
VDNSSVDFQKFPDKEILRMAGPLTADFIVKIRNSGSADSTVQFIFYQPIIHRWRETDFFPCS
ATCGGGYQLTSAECYDLRSNRVVADQYCHYYPENIKPKPKLQECNLDPCPASDGYKQIMPYD
LYHPLPRWEATPWTACSSSCGGGIQSRAVSCVEEDIQGHVTSVEEWKCMYTPKMPIAQPCNI
FDCPKWLAQEWSPCTVTCGQGLRYRVVLCIDHRGMHTGGCSPKTKPHIKEECIVPTPCYKPK
EKLPVEAKLPWFKQAQELEEGAAVSEEPS
```

Important features:

Signal peptide:

amino acids 1-25

N-glycosylation site.

amino acids 251-254

Thrombospondin 1 amino acids 385-399 von Willebrand factor type C domain proteins amino acids 385-399, 445-459 and 42-56

FIGURE 121

```
CGGACGCGTGGGCGGCGGCTGCGGAACTCCCGTGGAGGGGCCGGTGGGCCCTCGGGCCTGAC
AGATGGCAGTGGCCACTGCGGCGGCAGTACTGGCCGCTCTGGGCGGGGCGCTGTGGCTGGCG
GCCCGCCGGTTCGTGGGGCCCAGGGTCCAGCGGCTGCGCAGAGGCGGGGACCCCGGCCTCAT
GCACGGGAAGACTGTGCTGATCACCGGGGCGAACAGCGGCCTGGGCCGCGCCACGGCCGCCG
AGCTACTGCGCCTGGGAGCGCGGTGATCATGGGCTGCCGGGACCGCGCGCGCGCCGAGGAG
GCGGCGGGTCAGCTCCGCCGCGAGCTCCGCCAGGCCGCGGAGTGCGGCCCAGAGCCTGGCGT
CAGCGGGGTGGGCGAGCTCATAGTCCGGGAGCTGGACCTCGCCTCGCTGCGCTCGGTGCGCG
CCTTCTGCCAGGAAATGCTCCAGGAAGAGCCTAGGCTGGATGTCTTGATCAATAACGCAGGG
ATCTTCCAGTGCCCTTACATGAAGACTGAAGATGGGTTTGAGATGCAGTTCGGAGTGAACCA
TCTGGGGCACTTTCTACTCACCAATCTTCTCCTTGGACTCCTCAAAAGTTCAGCTCCCAGCA
GGATTGTGGTAGTTTCTTCCAAACTTTATAAATACGGAGACATCAATTTTGATGACTTGAAC
AGTGAACAAAGCTATAATAAAAGCTTTTGTTATAGCCGGAGCAAACTGGCTAACATTCTTTT
TACCAGGGAACTAGCCCGCCGCTTAGAAGGCACAAATGTCACCGTCAATGTGTTGCATCCTG
GTATTGTACGGACAAATCTGGGGAGGCACATACACATTCCACTGTTGGTCAAACCACTCTTC
AATTTGGTGTCATGGGCTTTTTTCAAAACTCCAGTAGAAGGTGCCCAGACTTCCATTTATTT
GGCCTCTTCACCTGAGGTAGAAGGAGTGTCAGGAAGATACTTTGGGGATTGTAAAGAGGAAG
AACTGTTGCCCAAAGCTATGGATGAATCTGTTGCAAGAAAACTCTGGGATATCAGTGAAGTG
ATGGTTGGCCTGCTAAAATAGGAACAAGGAGTAAAAGAGCTGTTTATAAAACTGCATATCAG
TTATATCTGTGATCAGGAATGGTGTGGATTGAGAACTTGTTACTTGAAGAAAAGAATTTTG
ATATTGGAATAGCCTGCTAAGAGGTACATGTGGGTATTTTGGAGTTACTGAAAAATTATTTT
TGGGATAAGAGAATTTCAGCAAAGATGTTTTAAATATATATAGTAAGTATAATGAATAATAA
GTACAATGAAAAATACAATTATATTGTAAAATTATAACTGGGCAAGCATGGATGACATATTA
ATATTTGTCAGAATTAAGTGACTCAAAGTGCTATCGAGAGGTTTTTCAAGTATCTTTGAGTT
TCATGGCCAAAGTGTTAACTAGTTTTACTACAATGTTTGGTGTTTGTGTGGAAATTATCTGC
CTGGTGTGTGCACACAAGTCTTACTTGGAATAAATTTACTGGTAC
```

FIGURE 122

</usr/seqdb2/sst/DNA/Dnaseqs.min/ss.DNA58747
<subunit 1 of 1, 336 aa, 1 stop
<MW: 36865, pI: 9.15, NX(S/T): 2

MAVATAAAVLAALGGALWLAARRFVGPRVQRLRRGGDPGLMHGKTVLITGANSGLGRATAAE
LLRLGARVIMGCRDRARAEEAAGQLRRELRQAAECGPEPGVSGVGELIVRELDLASLRSVRA
FCQEMLQEEPRLDVLINNAGIFQCPYMKTEDGFEMQFGVNHLGHFLLTNLLLGLLKSSAPSR
IVVVSSKLYKYGDINFDDLNSEQSYNKSFCYSRSKLANILFTRELARRLEGTNVTVNVLHPG
IVRTNLGRHIHIPLLVKPLFNLVSWAFFKTPVEGAQTSIYLASSPEVEGVSGRYFGDCKEEE
LLPKAMDESVARKLWDISEVMVGLLK

Important features:

Signal peptide:
amino acids 1-21

Short-chain alcohol dehydrogenase family protein
amino acids 134-144, 44-56 and 239-248

N-glycosylation site.
amino acids 212-215 and 239-242

FIGURE 123

GGGGATTGTAAAGAGGAAGNACTGTGCCCAAAGNTATGGATGAATCTGTTGCAAGAAAATTN
TGGGATATCAGTGAAGTGATGGTTNGCCTGCTAAAATAGGAACAAGGAGTAAAAGAGCTGTT
TATAAAACTGCATATCAGTTATATCTGTGATCAGGAATGGTGTGGATTGAGAACTTGTTACT
TGAAGAAAAGAATTTTGATATTGGAATAGCCTGNTAAGAGGNACATGTGGGTATTTTGGAG
TTACTGAAAAATTATTTTTGGGATAAGAGAATTTCAGCAAAGATGTTTTAAATATATATAGT
AAGTATAATGAATAATAAGTACAATGAAAAATACAATTATATTGTAAAATTATAACTGGGCA
AGCATGGATGACATATTAATATTTGTCAGAATTAAGTGACTCAAAGTGCTATCGAGAGGTTT
TTCAAGTATCTTTGAGTTTCATGGCCAAAGTGTTAACTAGTTTTACTACAATGTTTGGTGTT
TGTGTGGAAATTATCTGCCTGGCTT

FIGURE 124

GAGAGGACGAGGTGCCGCTGCCTGGAGAATCCTCCGCTGCCGTCGGCTCCCGGAGCCCAGCC
CTTTCCTAACCCAACCCAACCTAGCCCAGTCCCAGCCGCCAGCGCCTGTCCCTGTCACGGAC
CCCAGCGTTACCATGCATCCTGCCGTCTTCCTATCCTTACCCGACCTCAGATGCTCCCTTCT
GCTCCTGGTAACTTGGGTTTTTACTCCTGTAACAACTGAAATAACAAGTCTTGCTACAGAGA
ATATAGATGAAATTTTAAACAATGCTGATGTTGCTTTAGTAAATTTTTATGCTGACTGGTGT
CGTTTCAGTCAGATGTTGCATCCAATTTTTGAGGAAGCTTCCGATGTCATTAAGGAAGAATT
TCCAAATGAAAATCAAGTAGTGTTTGCCAGAGTTGATTGTGATCAGCACTCTGACATAGCCC
AGAGATACAGGATAAGCAAATACCCAACCCTCAAATTGTTTCGTAATGGGATGATGATGAAG
AGAGAATACAGGGGTCAGCGATCAGTGAAAGCATTGGCAGATTACATCAGGCAACAAAAAAG
TGACCCCATTCAAGAAATTCGGGACTTAGCAGAAATCACCACTCTTGATCGCAGCAAAAGAA
ATATCATTGGATATTTTGAGCAAAAGGACTCGGACAACTATAGAGTTTTTGAACGAGTAGCG
AATATTTTGCATGATGACTGTGCCTTTCTTTCTGCATTTGGGGATGTTTCAAAACCGGAAAG
ATATAGTGGCGACAACATAATCTACAAACCACCAGGGCATTCTGCTCCGGATATGGTGTACT
TGGGAGCTATGACAAATTTTGATGTGACTTACAATTGGATTCAAGATAAATGTGTTCCTCTT
GTCCGAGAAATAACATTTGAAAATGGAGAGGAATTGACAGAAGAAGGACTGCCTTTTCTCAT
ACTCTTTCACATGAAAGAAGATACAGAAAGTTTAGAAATATTCCAGAATGAAGTAGCTCGGC
AATTAATAAGTGAAAAAGGTACAATAAACTTTTTACATGCCGATTGTGACAAATTTAGACAT
CCTCTTCTGCACATACAGAAAACTCCAGCAGATTGTCCTGTAATCGCTATTGACAGCTTTAG
GCATATGTATGTGTTTGGAGACTTCAAAGATGTATTAATTCCTGGAAAACTCAAGCAATTCG
TATTTGACTTACATTCTGGAAAACTGCACAGAGAATTCCATCATGGACCTGACCCAACTGAT
ACAGCCCCAGGAGAGCAAGCCCAAGATGTAGCAAGCAGTCCACCTGAGAGCTCCTTCCAGAA
ACTAGCACCCAGTGAATATAGGTATACTCTATTGAGGGATCGAGATGAGCTTTAAAAACTTG
AAAAACAGTTTGTAAGCCTTTCAACAGCAGCATCAACCTACGTGGTGGAAATAGTAAACCTA
TATTTTCATAATTCTATGTGTATTTTTATTTTGAATAAACAGAAGAAATTTAAAAAAAAAA
AAAAAAAAAAAAAAAAAAAAAAAAAAAAAAA

FIGURE 125

```
</usr/seqdb2/sst/DNA/Dnaseqs.min/ss.DNA57689
<subunit 1 of 1, 406 aa, 1 stop
<MW: 46927, pI: 5.21, NX(S/T): 0
MHPAVFLSLPDLRCSLLLLVTWVFTPVTTEITSLATENIDEILNNADVALVNFYADWCRFSQ
MLHPIFEEASDVIKEEFPNENQVVFARVDCDQHSDIAQRYRISKYPTLKLFRNGMMMKREYR
GQRSVKALADYIRQQKSDPIQEIRDLAEITTLDRSKRNIIGYFEQKDSDNYRVFERVANILH
DDCAFLSAFGDVSKPERYSGDNIIYKPPGHSAPDMVYLGAMTNFDVTYNWIQDKCVPLVREI
TFENGEELTEEGLPFLILFHMKEDTESLEIFQNEVARQLISEKGTINFLHADCDKFRHPLLH
IQKTPADCPVIAIDSFRHMYVFGDFKDVLIPGKLKQFVFDLHSGKLHREFHHGPDPTDTAPG
EQAQDVASSPPESSFQKLAPSEYRYTLLRDRDEL
```

Important features:

Signal peptide:

amino acids 1-29

Endoplasmic reticulum targeting sequence.

amino acids 403-406

Tyrosine kinase phosphorylation site.

amino acids 203-211

Thioredoxin family proteins amino acids 50-66

FIGURE 126

ATTAAGGAAGAATTTCCAAATGAAAATCAAGTAGTNTTTGCCAGAGTNGATTGTGATCAGCA
CTCTGACATAGCCCAGAGATACAGGATAAGCAAATACCCAACCCTCAAATTGTTTCGTAATG
GGATGATGATGAAGAGAGAATACAGGGGTCAGCGATCAGTGAAAGCATTGGCAGATTA

FIGURE 127

```
AGAGGCCTCTCTGGAAGTTGTCCCGGGTGTTCGCCGCNGGAGCCCGGGTCGAGAGGACNAGG
TGCCGCTGCCTGGAGAATCCTCCGCTGCCGTCGGCTCCCGGAGCCCAGCCCTTTCCTAACCC
AACCCAACCTAGCCCNGTCCCAGCCGCCAGCGCCTGTCCCTGTCNCGGANCCCAGCGTNACC
ATGCATCCTGCCGTCTTCCTATCCTTACCCGACCTCAGATGCTCCCTTCTGCTCCTGGTAAC
TTGGGTTTTTACTCCTGTAACAACTGAAATAACNNGTCTTGATACNNAGAATATAGATGAAA
TTTTAAACNATGCTGATGTGGCTTTAGTCAATTTTTATGCTGACTGGTGTCGTTTCAGTCAG
ATGTGGCATCCAATTTTTGAGGANGCTTCCGATGTCATTAAGGAAGAATTTCCAAATGAAAA
TCAAGTAGTGTTTGCCAGAGTTGATTGTGATCAGCACTCTGACATAGCCCAGAGATACAGGA
TAAGCAAATACCCAACCCTCAAATTGTTTCGTAATGGGATGATGATGAAGAGAGAATACAGG
GGTCAGCGATCAGTGAAAGCATTGGCAGATTACATCAGGC
```

FIGURE 128

GCCCACGCGTCCG<u>ATG</u>GCGTTCACGTTCGCGGCCTTCTGCTACATGCTGGCGCTGCTGCTCA
CTGCCGCGCTCATCTTCTTCGCCATTTGGCACATTATAGCATTTGATGAGCTGAAGACTGAT
TACAAGAATCCTATAGACCAGTGTAATACCCTGAATCCCCTTGTACTCCCAGAGTACCTCAT
CCACGCTTTCTTCTGTGTCATGTTTCTTTGTGCAGCAGAGTGGCTTACACTGGGTCTCAATA
TGCCCCTCTTGGCATATCATATTTGGAGGTATATGAGTAGACCAGTGATGAGTGGCCCAGGA
CTCTATGACCCTACAACCATCATGAATGCAGATATTCTAGCATATTGTCAGAAGGAAGGATG
GTGCAAATTAGCTTTTTATCTTCTAGCATTTTTTTACTACCTATATGGCATGATCTATGTTT
TGGTGAGCTCT<u>TAG</u>AACAACACACAGAAGAATTGGTCCAGTTAAGTGCATGCAAAAGCCAC
CAAATGAAGGGATTCTATCCAGCAAGATCCTGTCCAAGAGTAGCCTGTGGAATCTGATCAGT
TACTTTAAAAAATGACTCCTTATTTTTTAAATGTTTCCACATTTTTGCTTGTGGAAAGACTG
TTTTCATATGTTATACTCAGATAAAGATTTTAAATGGTATTACGTATAAATTAATATAAAAT
GATTACCTCTGGTGTTGACAGGTTTGAACTTGCACTTCTTAAGGAACAGCCATAATCCTCTG
AATGATGCATTAATTACTGACTGTCCTAGTACATTGGAAGCTTTTGTTTATAGGAACTTGTA
GGGCTCATTTTGGTTTCATTGAAACAGTATCTAATTATAAATTAGCTGTAGATATCAGGTGC
TTCTGATGAAGTGAAAATGTATATCGACTAGTGGGAAACTTCATGGGTTTCCTCATCTGTC
ATGTCGATGATTATATATGGATACATTTACAAAATAAAAGCGGGAATTTTCCCTTCGCTT
GAATATTATCCCTGTATATTGCATGAATGAGAGATTTCCCATATTTCATCAGAGTAATAAA
TATACTTGCTTTAATTCTTAAGCATAAGTAAACATGATATAAAATATATGCTGAATTACTT
GTGAAGAATGCATTTAAAGCTATTTTAAATGTGTTTTTATTTGTAAGACATTACTTATTAAG
AAATTGGTTATTATGCTTACTGTTCTAATCTGGTGGTAAAGGTATTCTTAAGAATTTGCAGG
TACTACAGATTTTCAAAACTGAATGAGAGAAAATTGTATAACCATCCTGCTGTTCCTTTAGT
GCAATACAATAAAACTCTGAAATTAAGACTC

FIGURE 129

</usr/seqdb2/sst/DNA/Dnaseqs.min/ss.DNA23330
<subunit 1 of 1, 144 aa, 1 stop
<MW: 16699, pI: 5.60, NX(S/T): 0
MAFTFAAFCYMLALLLTAALIFFAIWHIIAFDELKTDYKNPIDQCNTLNPLVLPEYLIHAFF
CVMFLCAAEWLTLGLNMPLLAYHIWRYMSRPVMSGPGLYDPTTIMNADILAYCQKEGWCKLA
FYLLAFFYYLYGMIYVLVSS

Important features:

Signal peptide:

amino acids 1-20

Type II transmembrane domain:

amino acids 11-31

Other transmembrane domain:

amino acids 57-77 and 123-143

FIGURE 130

ATTATAGCATTTGATGAGCTGAAGACTGATTACAAGATCCTATAGACCAGTGTAATACCCTG
AATCCCCTTGTACTCCCAGAGTACCTCATCCACGCTTTCTTCTGTGTCATGTTTCTTTGTGC
AGCAGAGTGGCTTACACTGGGTCTCAATATGCCCCTCTTGGCATATCATATTTGGAGGTATA
TGAGTAGACCAGTGATGAGTGGCCCAGGACTCTATGACCCTACAACCATCATGAATGCAGAT
ATTCTAGCATATTGTCAGAAGGAAGGATGGTGCAAATTAGCTTTTTATCTTCTAGCATTTTT
TTACTACCTATATGGCATGATCTATGTTTTGGTGAGCTCTTAGAACAACACACAGAAGAATT
GGTCCAGTTAAGTGCATGCAAAAGCCACCAAATGAAGGGATTCTATCCAGCAAGATCCTGT
CCAAGAGTAGCCTGTGGAATCTGATCAGTTACTTTAAAAAATG

FIGURE 131

CGGACGCGTGGGGGAAACCCTTCCGAGAAAACAGCAACAAGCTGAGCTGCTGTGACAGAGGG
GAACAAGATGGCGGCGCCGAAGGGGAGCCTCTGGGTGAGGACCCAACTGGGGCTCCCGCCGC
TGCTGCTGCTGACCATGGCCTTGGCCGGAGGTTCGGGGACCGCTTCGGCTGAAGCATTTGAC
TCGGTCTTGGGTGATACGGCGTCTTGCCACCGGGCCTGTCAGTTGACCTACCCCTTGCACAC
CTACCCTAAGGAAGAGGAGTTGTACGCATGTCAGAGAGGTTGCAGGCTGTTTTCAATTTGTC
AGTTTGTGGATGATGGAATTGACTTAAATCGAACTAAATTGGAATGTGAATCTGCATGTACA
GAAGCATATTCCCAATCTGATGAGCAATATGCTTGCCATCTTGGTTGCCAGAATCAGCTGCC
ATTCGCTGAACTGAGACAAGAACAACTTATGTCCTGATGCCAAAAATGCACCTACTCTTTC
CTCTAACTCTGGTGAGGTCATTCTGGAGTGACATGATGGACTCCGCACAGAGCTTCATAACC
TCTTCATGGACTTTTTATCTTCAAGCCGATGACGGAAAAATAGTTATATTCCAGTCTAAGCC
AGAAATCCAGTACGCACCACATTTGGAGCAGGAGCCTACAAATTTGAGAGAATCATCTCTAA
GCAAAATGTCCTATCTGCAAATGAGAAATTCACAAGCGCACAGGAATTTTCTTGAAGATGGA
GAAAGTGATGGCTTTTTAAGATGCCTCTCTCTTAACTCTGGGTGGATTTTAACTACAACTCT
TGTCCTCTCGGTGATGGTATTGCTTTGGATTTGTTGTGCAACTGTTGCTACAGCTGTGGAGC
AGTATGTTCCCTCTGAGAAGCTGAGTATCTATGGTGACTTGGAGTTTATGAATGAACAAAAG
CTAAACAGATATCCAGCTTCTTCTCTTGTGGTTGTTAGATCTAAAACTGAAGATCATGAAGA
AGCAGGGCCTCTACCTACAAAAGTGAATCTTGCTCATTCTGAAATTTAAGCATTTTTCTTTT
AAAAGACAAGTGTAATAGACATCTAAAATTCCACTCCTCATAGAGCTTTTAAAATGGTTTCA
TTGGATATAGGCCTTAAGAAATCACTATAAAATGCAAATAAAGTTACTCAAATCTGTG

FIGURE 132

</usr/seqdb2/sst/DNA/Dnaseqs.min/ss.DNA26847
<subunit 1 of 1, 323 aa, 1 stop
<MW: 36223, pI: 5.06, NX(S/T): 1
MAAPKGSLWVRTQLGLPPLLLLTMALAGGSGTASAEAFDSVLGDTASCHRACQLTYPLHTYP
KEEELYACQRGCRLFSICQFVDDGIDLNRTKLECESACTEAYSQSDEQYACHLGCQNQLPFA
ELRQEQLMSLMPKMHLLFPLTLVRSFWSDMMDSAQSFITSSWTFYLQADDGKIVIFQSKPEI
QYAPHLEQEPTNLRESSLSKMSYLQMRNSQAHRNFLEDGESDGFLRCLSLNSGWILTTTLVL
SVMVLLWICCATVATAVEQYVPSEKLSIYGDLEFMNEQKLNRYPASSLVVVRSKTEDHEEAG
PLPTKVNLAHSEI

Important features:
Signal peptide:
amino acids 1-31

Transmembrane domain:
amino acids 241-260

N-glycosylation site.
amino acids 90-93

FIGURE 133

TTGGGTGATACGGCGTCTTGCCACCGGGCCTGTCAGTTGACCTACCCCTTGCACACCTACCC
TAAGGAAGAGGAGTTGTACGCATGTCAGAGAGGTTGCAGGCTGTTTTCAATTTGTCAGTTTG
TGGATGATGGAATTGACTTAAATCGAACTAAATTGGAATGTGAATCTGCATGTACAGAAGCA
TATTCCCAATCTGATGAGCAATATGCTTGCCATCTTGGTTGCCAGAATCAGCTGCCATTCGC
TGAACTGAGACAAGAACAACTTATGTCCCTGATGCCAAAAATGCACCTACTCTTTCCTCTAA
CTCTGGTGAGGTCATTCTGGAGTGACATGATGGACTCCGC

FIGURE 134

```
CACACTGGCCGGATCTTTTAGAGTCCTTTGACCTTGACCAAGGGTCNGGAAAACAGCAACAA
GCTGAGCTGCTGTGACAGAGGGAACAAGATGGCGGCGCCGAAGGGAGCCTTTGGGTGAGGAC
CCAACTGGGGCTCCCGCCGCTGCTGCTGACCATGGCCTTGGCCGGAGGTTCGGGGACCG
CTTCGGCTGAAGCATTTGACTCGGTCTTGGGTGATACGGCGTCTTGCCACCGGGCCTGTCAG
TTGACCTACCCCTTGCACACCTACCCTAAGGAAGAGGAGTTGTACGCATGTCAGAGAGGTTG
CAGGCTGTTTTCAATTTGTCAGTTTGTGGATGATGGAATTGACTTAAATCGAACTAAATTGG
AATGTGAATCTGCATGTACAGAAGCATATTCCCAATCTGATGAGCAATATGCTTGCCATCTT
GGTTGCCAGAATCAGCTGCCATTCGCTGAACTGAGACAAGAACAACTTATGTCCCTGATGCC
AAAAATGCACCTACTCTTTCCTCTAACTCTGGTGAGGTCATTCTGGAGTGACATGATGGACT
CCGC
```

FIGURE 135

```
GCGAGGTGGCGATCGCTGAGAGGCAGGAGGGCCGAGGCGGGCCTGGGAGGCGGCCCGGAGGT
GGGGCGCCGCTGGGGCCGGCCCGCACGGGCTTCATCTGAGGGCGCACGGCCCGCGACCGAGC
GTGCGGACTGGCCTCCCAAGCGTGGGGCGACAAGCTGCCGGAGCTGCAATGGGCCGCGGCTG
GGGATTCTTGTTTGGCCTCCTGGGCGCCGTGTGGCTGCTCAGCTCGGGCCACGGAGAGGAGC
AGCCCCGGAGACAGCGGCACAGAGGTGCTTCTGCCAGGTTAGTGGTTACTTGGATGATTGT
ACCTGTGATGTTGAAACCATTGATAGATTTAATAACTACAGGCTTTTCCCAAGACTACAAAA
ACTTCTTGAAAGTGACTACTTTAGGTATTACAAGGTAAACCTGAAGAGGCCGTGTCCTTTCT
GGAATGACATCAGCCAGTGTGGAAGAAGGGACTGTGCTGTCAAACCATGTCAATCTGATGAA
GTTCCTGATGGAATTAAATCTGCGAGCTACAAGTATTCTGAAGAAGCCAATAATCTCATTGA
AGAATGTGAACAAGCTGAACGACTTGGAGCAGTGGATGAATCTCTGAGTGAGGAAACACAGA
AGGCTGTTCTTCAGTGGACCAAGCATGATGATTCTTCAGATAACTTCTGTGAAGCTGATGAC
ATTCAGTCCCCTGAAGCTGAATATGTAGATTTGCTTCTTAATCCTGAGCGCTACACTGGTTA
CAAGGGACCAGATGCTTGGAAAATATGGAATGTCATCTACGAAGAAAACTGTTTTAAGCCAC
AGACAATTAAAGACCTTTAAATCCTTTGGCTTCTGGTCAAGGGACAAGTGAAGAGAACACT
TTTTACAGTTGGCTAGAAGGTCTCTGTGTAGAAAAAGAGCATTCTACAGACTTATATCTGG
CCTACATGCAAGCATTAATGTGCATTTGAGTGCAAGATATCTTTTACAAGAGACCTGGTTAG
AAAAGAAATGGGGACACAACATTACAGAATTTCAACAGCGATTTGATGGAATTTTGACTGAA
GGAGAAGGTCCAAGAAGGCTTAAGAACTTGTATTTTCTCTACTTAATAGAACTAAGGGCTTT
ATCCAAAGTGTTACCATTCTTCGAGCGCCCAGATTTTCAACTCTTTACTGGAAATAAAATTC
AGGATGAGGAAAACAAAATGTTACTTCTGGAAATACTTCATGAAATCAAGTCATTTCCTTTG
CATTTTGATGAGAATTCATTTTTTGCTGGGGATAAAAAAGAAGCACACAAACTAAAGGAGGA
CTTTCGACTGCATTTTAGAAATATTTCAAGAATTATGGATTGTGTTGGTTGTTTTAAATGTC
GTCTGTGGGGAAAGCTTCAGACTCAGGGTTTGGGCACTGCTCTGAAGATCTTATTTTCTGAG
AAATTGATAGCAAATATGCCAGAAAGTGGACCTAGTTATGAATTCCATCTAACCAGACAAGA
AATAGTATCATTATTCAACGCATTTGGAAGAATTTCTACAAGTGTGAAAGAATTAGAAAACT
TCAGGAACTTGTTACAGAATATTCATTAAAGAAAACAAGCTGATATGTGCCTGTTTCTGGAC
AATGGAGGCGAAAGAGTGGAATTTCATTCAAAGGCATAATAGCAATGACAGTCTTAAGCCAA
ACATTTTATATAAAGTTGCTTTTGTAAAGGAGAATTATATTGTTTTAAGTAAACACATTTTT
AAAAATTGTGTTAAGTCTATGTATAATACTACTGTGAGTAAAAGTAATACTTTAATAATGTG
GTACAAATTTTAAAGTTTAATATTGAATAAAAGGAGGATTATCAAATTAAAAAAAAAAAAAA
AAAAAAAAAAAAAAAAAAAAAAAA
```

FIGURE 136

```
</usr/seqdb2/sst/DNA/Dnaseqs.min/ss.DNA53974
<subunit 1 of 1, 468 aa, 1 stop
<MW: 54393, pI: 5.63, NX(S/T): 2
MGRGWGFLFGLLGAVWLLSSGHGEEQPPETAAQRCFCQVSGYLDDCTCDVETIDRFNNYRLF
PRLQKLLESDYFRYYKVNLKRPCPFWNDISQCGRRDCAVKPCQSDEVPDGIKSASYKYSEEA
NNLIEECEQAERLGAVDESLSEETQKAVLQWTKHDDSSDNFCEADDIQSPEAEYVDLLLNPE
RYTGYKGPDAWKIWNVIYEENCFKPQTIKRPLNPLASGQGTSEENTFYSWLEGLCVEKRAFY
RLISGLHASINVHLSARYLLQETWLEKKWGHNITEFQQRFDGILTEGEGPRRLKNLYFLYLI
ELRALSKVLPFFERPDFQLFTGNKIQDEENKMLLLEILHEIKSFPLHFDENSFFAGDKKEAH
KLKEDFRLHFRNISRIMDCVGCFKCRLWGKLQTQGLGTALKILFSEKLIANMPESGPSYEFH
LTRQEIVSLFNAFGRISTSVKELENFRNLLQNIH
```

Important features:

Signal peptide:

amino acids 1-23

N-glycosylation site.

amino acids 280-283 and 384-387

Amidation site.

amino acids 94-97

Glycosaminoglycan attachment site.

amino acids 20-23 and 223-226

Aminotransferases class-V pyridoxal-phosphate amino acids 216-222

Interleukin-7 proteins amino acids 338-343

FIGURE 137

GCTGGAAATATGGATGTCATCTACGAGAAACTGTTTTAAGCCACAGACAATTAAAAGACCTT

TAAATCCTTTGGCTTCTGGTCAAGGGACAAGTGAAGAGNACACTTTTTACAGTTGGCTAGAA

GGTCTCTGTGTAGAAAAAGAGCATTCTACAGACTTATATCTGGCCTACATGCAAGCATTAA

TGTGCATTTGAGTGCAAGATATCTTTTACAAGAGACCTGGTTAGAAAAGAAATGGGGACACA

ACATTACAGAATTTNAACAGCGATTTGATGGAATTTTGACTGAAGGAGAAGGTCCAAGAAGG

CTTAAGAACTTGTATTTTCTCTACTTAATAGAACTAAGGGCTTTATCCAAAGTGTTACCATT

CTTNGAGCGCCCAGATTTTCAACTNTTTACTGGAAATAAAATTCAGGATGAGGNAAACAAAA

TGTTACTTTTGGAAATACTTCATGAAATCAAGTCATTTCCTTTGCATTTTGATGAGAATTCA

TTTTTTTGCTG

FIGURE 138

CGGACGCGTGGGCGGACGCGTGGGCGGACGCGTGGGTTGGGAGGGGGCAGGATGGGAGGGAA
AGTGAAGAAAACAGAAAAGGAGAGGGACAGAGGCCAGAGGACTTCTCATACTGGACAGAAAC
CGATCAGGCATGGAACTCCCCTTCGTCACTCACCTGTTCTTGCCCCTGGTGTTCCTGACAGG
TCTCTGCTCCCCCTTTAACCTGGATGAACATCACCCACGCCTATTCCCAGGGCCACCAGAAG
CTGAATTTGGATACAGTGTCTTACAACATGTTGGGGGTGGACAGCGATGGATGCTGGTGGGC
GCCCCCTGGGATGGGCCTTCAGGCGACCGGAGGGGGGACGTTTATCGCTGCCCTGTAGGGGG
GGCCCACAATGCCCCATGTGCCAAGGGCCACTTAGGTGACTACCAACTGGGAAATTCATCTC
ATCCTGCTGTGAATATGCACCTGGGGATGTCTCTGTTAGAGACAGATGGTGATGGGGATTC
ATGGTGAGCTAAGGAGAGGGTGGTGGCAGTGTCTCTGAAGGTCCATAAAAGAAAAAGAGAA
GTGTGGTAAGGGAAAATGGTCTGTGTGGAGGGGTCAAGGAGTTAAAAACCCTAGAAAGCAAA
AGGTAGGTAATGTCAGGGAGTAGTCTTCATGCCTCCTTCAACTGGGAGCATGTTCTGAGGGT
GCCCTCCCAAGCCTGGGAGTAACTATTTCCCCCATCCCCAGGCCTGTGCCCCTCTCTGGTCT
CGTGCTTGTGGCAGCTCTGTCTTCAGTTCTGGGATATGTGCCCGTGTGGATGCTTCATTCCA
GCCTCAGGGAAGCCTGGCACCCACTGCCCAACGTGAGCCAGAGGAAGGCTGAGTACTTGGTT
CCCAGAAGGAGATACTGGGTGGGAAAAGATGGGGCAAAGCGGTATGATGCCTGGCAAAGGG
CCTGCATGGCTATCCTCATTGCTACCTAATGTGCTTGCAAAAGCTCCATGTTTCCTAACAGA
TTCAGACTCCTGGCCAGGTGTGGTGGCCCACACCTGTAATTCTAGCACTTTGGGAGGCCAAG
GTGGGCAGATCACTTGAGGTCAGGAGTTCAAGACCAGCCTGGCCAACATGGTGAAACTCCAT
CTCTACTAAAAAAAAAAAAATACAAAAATTAGCTGGGTGCGCTAGTGCATGCCTGTAATCTC
ATCTACTCGGGAGGCTAAGACAGGAGACTCTCACTTCAACCCAGGAGGTGGAGGTTGCGGTG
AGCCAAGATTGTGCCTCTGCACTCTAGCGTGGGTGACAGAGTAAGCGAGACTCCATCTCAAA
AATAATAATAATAATAATTCAGACTCCTTATCAGGAGTCCATGATCTGGCCTGGCACAGTAA
CTCATGCCTGTAATCCCAACATTTTGGGAGGCCAACGCAGGAGGATTGCTTGAGGTCTGGAG
GTTTGAGACCAGCCTGGGCAACATAGAAAGACCCCATCTCTAAATAAATGTTTTAAAAAT

FIGURE 139

></usr/seqdb2/sst/DNA/Dnaseqs.min/ss.DNA57039
><subunit 1 of 1, 124 aa, 1 stop
><MW: 13352, pI: 5.99, NX(S/T): 1
MELPFVTHLFLPLVFLTGLCSPFNLDEHHPRLFPGPPEAEFGYSVLQHVGGGQRWMLVGAPW
DGPSGDRRGDVYRCPVGGAHNAPCAKGHLGDYQLGNSSHPAVNMHLGMSLLETDGDGGFMVS

Important features:

Signal peptide:

amino acids 1-22

Cell attachment sequence.

amino acids 70-73

N-glycosylation site.

amino acids 98-101

Integrins alpha chain proteins amino acids 67-81

FIGURE 140

CACAGTTCCCCACCATCACTCNTCCCATTCCTTCCAACTTTATTTTTAGCTTGCCATTGGGA
GGGGGCAGGATGGGAGGGAAAGTGAAGAAAACAGAAAAGGAGAGGGACAGAGGCCAGAGGAC
TTCTCATACTGGACAGAAACCGATCAGGCATGGAACTCCCCTTCGTCACTCACCTGTTCTTG
CCCCTGGTGTTCCTGACAGGTCTCTGCTCCCCCTTTAACCTGGATGAACATCACCCACGCCT
ATTCCCAGGGCCACCAGAAGCTGAATTTGGATACAGTGTCTTACAACATGTTGGGGGTGGAC
AGCGATGGATGCTGGTGGGCGCCCCCTGGGATGGGCCTTCAGGCGACCGGAGGGGGGACGTT
TATCGCTGCCCTGTAGGGGGGGCCCACAATGCCCCATGTGCCAAGGGCCACTTAGGTGACTA
CCAACTGGGAAATTCATCTCATCCTGCTGTGAATATGCACCTGGGGATGTCTCTGTTAGAGA
CAGATGGTGATGG

FIGURE 141

```
AAAGTTACATTTTCTCTGGAACTCTCCTAGGCCACTCCCTGCTGATGCAACATCTGGGTTTG
GGCAGAAAGGAGGGTGCTTCGGAGCCCGCCCTTTCTGAGCTTCCTGGGCCGGCTCTAGAACA
ATTCAGGCTTCGCTGCGACTCAGACCTCAGCTCCAACATATGCATTCTGAAGAAAGATGGCT
GAGATGGACAGAATGCTTTATTTTGGAAAGAAACAATGTTCTAGGTCAAACTGAGTCTACCA
AATGCAGACTTTCACAATGGTTCTAGAAGAAATCTGGACAAGTCTTTTCATGTGGTTTTTCT
ACGCATTGATTCCATGTTTGCTCACAGATGAAGTGGCCATTCTGCCTGCCCCTCAGAACCTC
TCTGTACTCTCAACCAACATGAAGCATCTCTTGATGTGGAGCCCAGTGATCGCGCCTGGAGA
AACAGTGTACTATTCTGTCGAATACCAGGGGGAGTACGAGAGCCTGTACACGAGCCACATCT
GGATCCCCAGCAGCTGGTGCTCACTCACTGAAGGTCCTGAGTGTGATGTCACTGATGACATC
ACGGCCACTGTGCCATACAACCTTCGTGTCAGGGCCACATTGGGCTCACAGACCTCAGCCTG
GAGCATCCTGAAGCATCCCTTTAATAGAAACTCAACCATCCTTACCCGACCTGGGATGGAGA
TCACCAAGATGGCTTCCACCTGGTTATTGAGCTGGAGGACCTGGGCCCCAGTTTGAGTTC
CTTGTGGCCTACTGGAGGAGGGAGCCTGGTGCCGAGGAACATGTCAAAATGGTGAGGAGTGG
GGGTATTCCAGTGCACCTAGAAACCATGGAGCCAGGGGCTGCATACTGTGTGAAGGCCCAGA
CATTCGTGAAGGCCATTGGGAGGTACAGCGCCTTCAGCCAGACAGAATGTGTGGAGGTGCAA
GGAGAGGCCATTCCCCTGGTACTGGCCCTGTTTGCCTTTGTTGGCTTCATGCTGATCCTTGT
GGTCGTGCCACTGTTCGTCTGGAAAATGGGCCGGCTGCTCCAGTACTCCTGTTGCCCCGTGG
TGGTCCTCCCAGACACCTTGAAAATAACCAATTCACCCCAGAAGTTAATCAGCTGCAGAAGG
GAGGAGGTGGATGCCTGTGCCACGGCTGTGATGTCTCCTGAGGAACTCCTCAGGGCCTGGAT
CTCATAGGTTTGCGGAAGGGCCCAGGTGAAGCCGAGAACCTGGTCTGCATGACATGGAAACC
ATGAGGGGACAAGTTGTGTTTCTGTTTTCCGCCACGGACAAGGGATGAGAGAAGTAGGAAGA
GCCTGTTGTCTACAAGTCTAGAAGCAACCATCAGAGGCAGGGTGGTTTGTCTAACAGAACAC
TGACTGAGGCTTAGGGGATGTGACCTCTAGACTGGGGGCTGCCACTTGCTGGCTGAGCAACC
CTGGGAAAAGTGACTTCATCCCTTCGGTCCTAAGTTTTCTCATCTGTAATGGGGAATTACC
TACACACCTGCTAAACACACACACAGAGTCTCTCTCTATATATACACACGTACACATAAA
TACACCCAGCACTTGCAAGGCTAGAGGGAAACTGGTGACACTCTACAGTCTGACTGATTCAG
TGTTTCTGGAGAGCAGGACATAAATGTATGATGAGAATGATCAAGGACTCTACACACTGGGT
GGCTTGGAGAGCCCACTTTCCAGAATAATCCTTGAGAGAAAAGGAATCATGGGAGCAATGG
TGTTGAGTTCACTTCAAGCCCAATGCCGGTGCAGAGGGGAATGGCTTAGCGAGCTCTACAGT
AGGTGACCTGGAGGAAGGTCACAGCCACACTGAAAATGGGATGTGCATGAACACGGAGGATC
CATGAACTACTGTAAAGTGTTGACAGTGTGTGCACACTGCAGACAGCAGGTGAAATGTATGT
GTGCAATGCGACGAGAATGCAGAAGTCAGTAACATGTGCATGTTTGTTGTGCTCCTTTTTTC
TGTTGGTAAAGTACAGAATTCAGCAAATAAAAGGGCCACCCTGGCCAAAAGCGGTAAAAAA
AAAAAAAAAA
```

FIGURE 142

```
</usr/seqdb2/sst/DNA/Dnaseqs.min/ss.DNA57033
<subunit 1 of 1, 311 aa, 1 stop
<MW: 35076, pI: 5.04, NX(S/T): 2
MQTFTMVLEEIWTSLFMWFFYALIPCLLTDEVAILPAPQNLSVLSTNMKHLLMWSPVIAPGE
TVYYSVEYQGEYESLYTSHIWIPSSWCSLTEGPECDVTDDITATVPYNLRVRATLGSQTSAW
SILKHPFNRNSTILTRPGMEITKDGFHLVIELEDLGPQFEFLVAYWRREPGAEEHVKMVRSG
GIPVHLETMEPGAAYCVKAQTFVKAIGRYSAFSQTECVEVQGEAIPLVLALFAFVGFMLILV
VVPLFVWKMGRLLQYSCCPVVVLPDTLKITNSPQKLISCRREEVDACATAVMSPEELLRAWIS
```

Important features:

Signal peptide:

amino acids 1-29

Transmembrane domain:

amino acids 230-255

N-glycosylation site.

amino acids 40-43 and 134-137

Tissue factor proteins.

amino acids 92-119

Integrins alpha chain proteins amino acids 232-262

FIGURE 143

TCCTGCTGATGCACATCTGGGTTTGGCAAAAGGAGGTTGCTTCGAGCCGCCCTTTCTAGCTT
CCTGGCCGGCTCTAGAACAATTCAGGCTTCGCTGCGACTAGACCTCAGCTCCAACATATGCA
TTCTGAAGAAAGATGGCTGAGATGACAGAATGCTTTATTTTGGAAAGAAACAATGTTCTAGG
TCAAACTGAGTCTACCAAATGCAGACTTTCACAATGGTTCTAGAAGAAATCTGGACAAGTCT
TTTCATGTGGTTTTTCTACGCATTGATTCCATGTTTGCTCACAGATGAAGTGGCCATTCTGC
CTGCCCCTCAGAACCTCTCTGTACTCTCAACCAACATGAAGCATCTCTTGATGTGGAGCCCA
GTGATCGCGCCTGGAGAAACAGTGTACTATTCTGTCGAATACCAGGGGGAGTACGAGAGCCT
GTACACGAGCCACATCTGGATCCCCAGCAGCTGGTGCTCACTCACTGAAGGTCCTGAGTGTG
ATGTCACTGATGACATCACGGCCACTGTGCCATACAACCTTTGTGTCAGGGCCACATTGGGC
TCACAGACCTCAGCCTGGAGCATCCTGAAGCATCCCTTTAATAGAAACTCAACCATCCTTAC
CCGACCTGGGATGGAGATCACCAAAGATGGCTTNCACCTGGTTATTGAGCTGGAGGACCTGG
GGCCCCAGTTTGAGTTCCTTGTGGCCTANTGGAGGAGGGGCGAACCCCTTGCGGCGCAAGGG
GTTNGCGAACCCCTTGCGGCCGCTGGGGTATCTCTCGAGAAAAGAGAGGCCCAATATGACCC
ACATACTCAATATGGACGAANTGCTATTGTCCACCTGTTTGAGTGGCGCTGGGTTGAT

FIGURE 144

```
CCCACGCGTCCGCCCACGCGTCCGAGGGACAAGAGAGAAGAGAGACTGAAACAGGGAGAAGA
GGCAGGAGAGGAGGAGGTGGGGAGAGCACGAAGCTGGAGGCCGACACTGAGGGAGGGCGGGA
GGAGGTGAAGAAGGAGAGAGGGGAGAAGAGGCAGGAGCTGGAAAGGAGAGAGGGAGGAGGAG
GAGGAGATGCGGGATGGAGACCTGGAGTTAGGTGGCTTGGGAGAGCTTAATGAAAAGAGAAC
GGAGAGGAGGTGTGGGTTAGGAACCAAGAGGTAGCCCTGTGGGCAGCAGAAGGCTGAGAGGA
GTAGGAAGATCAGGAGCTAGAGGGAGACTGGAGGGTTCCGGGAAAAGAGCAGAGGAAAGAGG
AAAGACACAGAGAGACGGGAGAGAGAAGAAGAGTGGGTTTGAAGGGCGGATCTCAGTCCCTG
GCTGCTTTGGCATTTGGGGAACTGGGACTCCCTGTGGGGAGGAGAGGAAAGCTGGAAGTCCT
GGAGGGACAGGGTCCCAGAAGGAGGGGACAGAGGAGCTGAGAGAGGGGGCAGGGCGTTGGG
CAGGGGTCCCTCGGAGGCCTCCTGGGGATGGGGGCTGCAGCTCGTCTGAGCGCCCTCGAGC
GCTGGTACTCTGGGCTGCACTGGGGGCAGCAGCTCACATCGGACCAGCACCTGACCCCGAGG
ACTGGTGGAGCTACAAGGATAATCTCCAGGGAAACTTCGTGCCAGGGCCTCCTTTCTGGGGC
CTGGTGAATGCAGCGTGGAGTCTGTGTGCTGTGGGGAAGCGGCAGAGCCCCGTGGATGTGGA
GCTGAAGAGGGTTCTTTATGACCCCTTTCTGCCCCCATTAAGGCTCAGCACTGGAGGAGAGA
AGCTCCGGGGAACCTTGTACAACACCGGCCGACATGTCTCCTTCCTGCCTGCACCCCGACCT
GTGGTCAATGTGTCTGGAGGTCCCCTCCTTTACAGCCACCGACTCAGTGAACTGCGGCTGCT
GTTTGGAGCTCGCGACGGAGCCGGCTCGGAACATCAGATCAACCACCAGGGCTTCTCTGCTG
AGGTGCAGCTCATTCACTTCAACCAGGAACTCTACGGGAATTTCAGCGCTGCCTCCCGCGGC
CCCAATGGCCTGGCCATTCTCAGCCTCTTTGTCAACGTTGCCAGTACCTCTAACCCATTCCT
CAGTCGCCTCCTTAACCGCGACACCATCACTCGCATCTCCTACAAGAATGATGCCTACTTTC
TTCAAGACCTGAGCCTGGAGCTCCTGTTCCCTGAATCCTTCGGCTTCATCACCTATCAGGGC
TCTCTCAGCACCCCGCCCTGCTCCGAGACTGTCACCTGGATCCTCATTGACCGGGCCCTCAA
TATCACCTCCCTTCAGATGCACTCCCTGAGACTCCTGAGCCAGAATCCTCCATCTCAGATCT
TCCAGAGCCTCAGCGGTAACAGCCGGCCCCTGCAGCCCTTGGCCCACAGGGCACTGAGGGGC
AACAGGGACCCCCGGCACCCCGAGAGGCGCTGCCGAGGCCCCAACTACCGCCTGCATGTGGA
TGGTGTCCCCCATGGTCGCTGAGACTCCCCTTCGAGGATTGCACCCGCCCGTCCTAAGCCTC
CCCACAAGGCGAGGGGAGTTACCCCTAAAACAAAGCTATTAAGGGACAGAATACTTA
```

FIGURE 145

</usr/seqdb2/sst/DNA/Dnaseqs.min/ss.DNA34353
<subunit 1 of 1, 328 aa, 1 stop
<MW: 36238, pI: 9.90, NX(S/T): 3
MGAAARLSAPRALVLWAALGAAAHIGPAPDPEDWWSYKDNLQGNFVPGPPFWGLVNAAWSLC
AVGKRQSPVDVELKRVLYDPFLPPLRLSTGGEKLRGTLYNTGRHVSFLPAPRPVVNVSGGPL
LYSHRLSELRLLFGARDGAGSEHQINHQGFSAEVQLIHFNQELYGNFSAASRGPNGLAILSL
FVNVASTSNPFLSRLLNRDTITRISYKNDAYFLQDLSLELLFPESFGFITYQGSLSTPPCSE
TVTWILIDRALNITSLQMHSLRLLSQNPPSQIFQSLSGNSRPLQPLAHRALRGNRDPRHPER
RCRGPNYRLHVDGVPHGR

Important features:

Signal peptide:

amino acids 1-23

Transmembrane domain:

amino acids 177-199

N-glycosylation site.

amino acids 118-121, 170-173 and 260-263

Eukaryotic-type carbonic anhydrases proteins amino acids 222-270, 128-164 and 45-92

FIGURE 146

```
GGCGCCTGGTTCTGCGCGTACTGGCTGTACGGAGCAGGAGCAAGAGGTCGCCGCCAGCCTCCGCCGCCGAGCCTC
GTTCGTGTCCCCGCCCCTCGCTCCTGCAGCTACTGCTCAGAAACGCTGGGGCGCCCACCCTGGCAGACTAACGAA
GCAGCTCCCTTCCCACCCCAACTGCAGGTCTAATTTTGGACGCTTTGCCTGCCATTTCTTCCAGGTTGAGGGAGC
CGCAGAGGCGGAGGCTCGCGTATTCCTGCAGTCAGCACCCACGTCGCCCCCGGACGCTCGGTGCTCAGGCCCTTC
GCGAGCGGGGCTCTCCGTCTGCGGTCCCTTGTGAAGGCTCTGGGCGGCTGCAGAGGCCGGCCGTCCGGTTTGGCT
CACCTCTCCCAGGAAACTTCACACTGGAGAGCCAAAAGGAGTGGAAGAGCCTGTCTTGGAGATTTTCCTGGGGAA
ATCCTGAGGTCATTCATTATGAAGTGTACCGCGCGGGAGTGGCTCAGAGTAACCACAGTGCTGTTCATGGCTAGA
GCAATTCCAGCCATGGTGGTTCCCAATGCCACTTTATTGGAGAAACTTTTGGAAAAATACATGGATGAGGATGGT
GAGTGGTGGATAGCCAAACAACGAGGGAAAAGGGCCATCACAGACAATGACATGCAGAGTATTTTGGACCTTCAT
AATAAATTACGAAGTCAGGTGTATCCAACAGCCTCTAATATGGAGTATATGACATGGGATGTAGAGCTGGAAAGA
TCTGCAGAATCCTGGGCTGAAAGTTGCTTGTGGAACATGGACCTGCAAGCTTGCTTCCATCAATTGGACAGAAT
TTGGGAGCACACTGGGGAAGATATAGGCCCCCGACGTTTCATGTACAATCGTGGTATGATGAAGTGAAAGACTTT
AGCTACCCATATGAACATGAATGCAACCCATATTGTCCATTCAGGTGTTCTGGCCCTGTATGTACACATTATACA
CAGGTCGTGTGGGCAACTAGTAACAGAATCGGTTGTGCCATTAATTTGTGTCATAACATGAACATCTGGGGCAG
ATATGGCCCAAAGCTGTCTACCTGGTGTGCAATTACTCCCCAAAGGGAAACTGGTGGGCCATGCCCCTTACAAA
CATGGGCGGCCCTGTTCTGCTTGCCCACCTAGTTTTGGAGGGGGCTGTAGAGAAAATCTGTGCTACAAAGAAGGG
TCAGACAGGTATTATCCCCCTCGAGAAGAGGAAACAAATGAAATAGAACGACAGCAGTCACAAGTCCATGACACC
CATGTCCGGACAAGATCAGATGATAGTAGCAGAAATGAAGTCATAAGCGCACAGCAAATGTCCCAAATTGTTTCT
TGTGAAGTAAGATTAAGAGATCAGTGCAAAGGAACAACCTGCAATAGGTACGAATGTCCTGCTGGCTGTTTGGAT
AGTAAAGCTAAAGTTATTGGCAGTGTACATTATGAAATGCAATCCAGCATCTGTAGAGCTGCAATTCATTATGGT
ATAATAGACAATGATGGTGGCTGGGTAGATATCACTAGACAAGGAAGAAAAGCATTATTTCATCAAGTCCAATAGA
AATGGTATTCAAACAATTGGCAAATATCAGTCTGCTAATTCCTTCACAGTCTCTAAAGTAACAGTTCAGGCTGTG
ACTTGTGAAACAACTGTGGAACAGCTCTGTCCATTTCATAAGCCTGCTTCACATTGCCCAAGAGTATACTGTCCT
CGTAACTGTATGCAAGCAAATCCACATTATGCTCGTGTAATTGGAACTCGAGTTTATTCTGATCTGTCCAGTATC
TGCAGAGCAGCAGTACATGCTGGAGTGGTTCGAAATCACGGTGGTTATGTTGATGTAATGCCTGTGGACAAAAGA
AAGACCTACATTGCTTCTTTTCAGAATGGAATCTTCTCAGAAAGTTTACAGAATCCTCCAGGAGGAAAGGCATTC
AGAGTGTTTGCTGTTGTGTGAAACTGAATACTTGGAAGAGGACCATAAAGACTATTCCAAATGCAATATTTCTGA
ATTTTGTATAAAACTGTAACATTACTGTACAGAGTACATCAACTATTTTCAGCCCAAAAAGGTGCCAAATGCATA
TAAATCTTGATAAACAAAGTCTATAAAATAAAACATGGACATTAGCTTTGGGAAAAGTAATGAAATATAATGG
TTTTAGAAATCCTGTGTTAAATATTGCTATATTTTCTTAGCAGTTATTTCTACAGTTAATTACATAGTCATGATT
GTTCTACGTTTCATATATTATATGGTGCTTTGTATATGCCACTAATAAAATGAATCTAAACATTGAATGTGAATG
GCCCTCAGAAAATCATCTAGTGCATTTAAAAATAATCGACTCTAAAACTGAAAGAAACCTTATCACATTTTCCCC
AGTTCAATGCTATGCCATTACCAACTCCAAATAATCTCAAATAATTTTCCACTTAATAACTGTAAAGTTTTTTTC
TGTTAATTTAGGCATATAGAATATTAAATTCTGATATTGCACTTCTTATTTTATATAAAATAATCCTTTAATATC
CAAATGAATCTGTTAAAATGTTTGATTCCTTGGGAATGGCCTTAAAAATAAATGTAATAAAGTCAGAGTGGTGGT
ATGAAAACATTCCTAGTGATCATGTAGTAAATGTAGGGTTAAGCATGGACAGCCAGAGCTTTCTATGTACTGTTA
AAATTGAGGTCACATATTTTCTTTTGTATCCTGGCAAATACTCCTGCAGGCCAGGAAGTATAATAGCAAAAGTT
GAACAAAGATGAACTAATGTATTACATTACCATTGCCACTGATTTTTTTAAATGGTAAATGACCTTGTATATAA
ATATTGCCATATCATGGTACCTATAATGGTGATATATTTGTTTCTATGAAAAATGTATTGTGCTTTGATACTAAA
AATCTGTAAAATGTTAGTTTTGGTAATTTTTTTTCTGCTGGTGGATTTACATATTAAATTTTTTCTGCTGGTGGA
TAAACATTAAAATTAATCATGTTTCAAAAAAAAAAAA
```

FIGURE 147

</usr/seqdb2/sst/DNA/Dnaseqs.min/ss.DNA45417
<subunit 1 of 1, 500 aa, 1 stop
<MW: 56888, pI: 8.53, NX(S/T): 2

MKCTAREWLRVTTVLFMARAIPAMVVPNATLLEKLLEKYMDEDGEWWIAKQRGKRAITDNDM
QSILDLHNKLRSQVYPTASNMEYMTWDVELERSAESWAESCLWEHGPASLLPSIGQNLGAHW
GRYRPPTFHVQSWYDEVKDFSYPYEHECNPYCPFRCSGPVCTHYTQVVWATSNRIGCAINLC
HNMNIWGQIWPKAVYLVCNYSPKGNWWGHAPYKHGRPCSACPPSFGGGCRENLCYKEGSDRY
YPPREEETNEIERQQSQVHDTHVRTRSDDSSRNEVISAQQMSQIVSCEVRLRDQCKGTTCNR
YECPAGCLDSKAKVIGSVHYEMQSSICRAAIHYGIIDNDGGWVDITRQGRKHYFIKSNRNGI
QTIGKYQSANSFTVSKVTVQAVTCETTVEQLCPFHKPASHCPRVYCPRNCMQANPHYARVIG
TRVYSDLSSICRAAVHAGVVRNHGGYVDVMPVDKRKTYIASFQNGIFSESLQNPPGGKAFRV
FAVV

Important features:

Signal peptide:

amino acids 1-20

Extracellular proteins SCP/Tpx-1/Ag5/PR-1/Sc7 protein amino acids 165-186, 196-218, 134-146, 96-108 and 58-77

N-glycosylation site amino acids 28-31

FIGURE 148

GCGGAGACAAGCGCAGAGCGCAGCGCACGGCCACAGACAGCCCTGGGCATCCACCGACGGCG
CAGCCGGAGCCAGCAGAGCCGGAAGGCGCGCCCCGGGCAGAGAAAGCCGAGCAGAGCTGGGT
GGCGTCTCCGGGCCGCCGCTCCGACGGGCCAGCGCCCTCCCCATGTCCCTGCTCCCACGCCG
CGCCCCTCCGGTCAGCATGAGGCTCCTGGCGGCCGCGCTGCTCCTGCTGCTGCTGGCGCTGT
ACACCGCGCGTGTGGACGGGTCCAAATGCAAGTGCTCCCGGAAGGGACCCAAGATCCGCTAC
AGCGACGTGAAGAAGCTGGAAATGAAGCCAAAGTACCCGCACTGCGAGGAGAAGATGGTTAT
CATCACCACCAAGAGCGTGTCCAGGTACCGAGGTCAGGAGCACTGCCTGCACCCCAAGCTGC
AGAGCACCAAGCGCTTCATCAAGTGGTACAACGCCTGGAACGAGAAGCGCAGGGTCTACGAA
GAATAGGGTGAAAAACCTCAGAAGGGAAAACTCCAAACCAGTTGGGAGACTTGTGCAAAGGA
CTTTGCAGATTAAAAAAAAAAAAAAAAAAAAAAAAAAAAAAAAAAAAAAAAAAGCCTTTC
TTTCTCACAGGCATAAGACACAAATTATATATTGTTATGAAGCACTTTTTACCAACGGTCAG
TTTTTACATTTTATAGCTGCGTGCGAAAGGCTTCCAGATGGGAGACCCATCTCTCTTGTGCT
CCAGACTTCATCACAGGCTGCTTTTTATCAAAAAGGGGAAAACTCATGCCTTTCCTTTTTAA
AAAATGCTTTTTTGTATTTGTCCATACGTCACTATACATCTGAGCTTTATAAGCGCCCGGGA
GGAACAATGAGCTTGGTGGACACATTTCATTGCAGTGTTGCTCCATTCCTAGCTTGGGAAGC
TTCCGCTTAGAGGTCCTGGCGCCTCGGCACAGCTGCCACGGGCTCTCCTGGGCTTATGGCCG
GTCACAGCCTCAGTGTGACTCCACAGTGGCCCCTGTAGCCGGGCAAGCAGGAGCAGGTCTCT
CTGCATCTGTTCTCTGAGGAACTCAAGTTTGGTTGCCAGAAAAATGTGCTTCATTCCCCCCT
GGTTAATTTTTACACACCCTAGGAAACATTTCCAAGATCCTGTGATGGCGAGACAAATGATC
CTTAAAGAAGGTGTGGGGTCTTTCCCAACCTGAGGATTTCTGAAAGGTTCACAGGTTCAATA
TTTAATGCTTCAGAAGCATGTGAGGTTCCCAACACTGTCAGCAAAAACCTTAGGAGAAAACT
TAAAAATATATGAATACATGCGCAATACACAGCTACAGACACACATTCTGTTGACAAGGGAA
AACCTTCAAAGCATGTTTCTTTCCCTCACCACAACAGAACATGCAGTACTAAAGCAATATAT
TTGTGATTCCCCATGTAATTCTTCAATGTTAAACAGTGCAGTCCTCTTTCGAAAGCTAAGAT
GACCATGCGCCCTTTCCTCTGTACATATACCCTTAAGAACGCCCCCTCCACACACTGCCCCC
CAGTATATGCCGCATTGTACTGCTGTGTTATATGCTATGTACATGTCAGAAACCATTAGCAT
TGCATGCAGGTTTCATATTCTTTCTAAGATGGAAAGTAATAAAATATATTTGAAATGTAAAA
AAAAAAAAAA

FIGURE 149

MSLLPRRAPPVSMRLLAAALLLLLLALYTARVDGSKCKCSRKGPKIRYSDVKKLEMKPKYPH
CEEKMVIITTKSVSRYRGQEHCLHPKLQSTKRFIKWYNAWNEKRRVYEE

Signal sequence:
amino acids 1-34

FIGURE 150

```
GCCCCAGGGACTGCTATGGCTTCCTTTGTTGTTCACCCCGGTCTGCGTCATGTTAAACTCCAATGTCCTCCTGTG
GTTAACTGCTCTTGCCATCAAGTTCACCCTCATTGACAGCCAAGCACAGTATCCAGTTGTCAACACAAATTATGG
CAAATCCGGGGCCTAAGAACACCGTTACCCAATGAGATCTTGGGTCCAGTGGAGCAGTACTTAGGGGTCCCCTA
TGCCTCACCCCCCACTGGAGAGAGGCGGTTTCAGCCCCCAGAACCCCCGTCCTCCTGGACTGGCATCCGAAATAC
TACTCAGTTTGCTGCTGTGTGCCCCCAGCACCTGGATGAGAGATCCTTACTGCATGACATGCTGCCCATCTGGTT
TACCGCCAATTTGGATACTTTGATGACCTATGTTCAAGATCAAAATGAAGACTGCCTTTACTTAAACATCTACGT
GCCCACGGAAGATGGAGCCAACACAAAGAAAAACGCAGATGATATAACGAGTAATGACCGTGGTGAAGACGAAGA
TATTCATGATCAGAACAGTAAGAAGCCCGTCATGGTCTATATCCATGGGGGATCTTACATGGAGGGCACCGGCAA
CATGATTGACGGCAGCATTTTGGCAAGCTACGGAAACGTCATCGTGATCACCATTAACTACCGTCTGGGAATACT
AGGGTTTTTAAGTACCGGTGACCAGGCAGCAAAAGGCAACTATGGGCTCCTGGATCAGATTCAAGCACTGCGGTG
GATTGAGGAGAATGTGGGAGCCTTTGGCGGGGACCCCAAGAGAGTGACCATCTTTTGGCTCGGGGGCTGGGGCCTC
CTGTGTCAGCCTGTTGACCCTGTCCCACTACTCAGAAGGTCTCTTCCAGAAGGCCATCATTCAGAGCGGCACCGC
CCTGTCCAGCTGGGCAGTGAACTACCAGCCGGCCAAGTACACTCGGATATTGGCAGACAAGGTCGGCTGCAACAT
GCTGGACACCACGGACATGGTAGAATGCCTGCGGAACAAGAACTACAAGGAGCTCATCCAGCAGACCATCACCCC
GGCCACCTACCACATAGCCTTCGGGCCGGTGATCGACGGCGACGTCATCCCAGACGACCCCCAGATCCTGATGGA
GCAAGGCGAGTTCCTCAACTACGACATCATGCTGGGCGTCAACCAAGGGGAAGGCCTGAAGTTCGTGGACGGCAT
CGTGGATAACGAGGACGGTGTGACGCCCAACGACTTTGACTTCTCCGTGTCCAACTTCGTGGACAACCTTTACGG
CTACCCTGAAGGGAAAGACACTTTGCGGGAGACTATCAAGTTCATGTACACAGACTGGGCCGATAAGGAAAACCC
GGGAGACGCGGCGGAAAACCCTGGTGGCTCTCTTTACTGACCACCAGTGGGTGGCCCCGCCGTGGCCGCCGACCT
GCACGCGCAGTACGGCTCCCCCACCTACTTCTATGCCTTCTATCATCACTGCCAAAGCGAAATGAAGCCCAGCTG
GGCAGATTCGGCCCATGGTGATGAGGTCCCCTATGTCTTCGGCATCCCCATGATCGGTCCCACCGAGCTCTTCAG
TTGTAACTTTTCCAAGAACGACGTCATGCTCAGCGCCGTGGTCATGACCTACTGGACGAACTTCGCCAAAACTGG
TGATCCAAATCAACCAGTTCCTCAGGATACCAAGTTCATTCACACAAAACCCAACCGCTTTGAAGAAGTGGCCTG
GTCCAAGTATAATCCCAAAGACCAGCTCTATCTGCATATTGGCTTGAAACCCAGAGTGAGAGATCACTACCGGGC
AACGAAAGTGGCTTTCTGGTTGGAACTCGTTCCTCATTTGCACAACTTGAACGAGATATTCCAGTATGTTTCAAC
AACCACAAAGGTTCCTCCACCAGACATGACATCATTTCCCTATGGCACCCGGCGATCTCCCGCCAAGATATGGCC
AACCACCAAACGCCCAGCAATCACTCCTGCCAACAATCCCAAACACTCTAAGGACCCTCACAAAACAGGGCCTGA
GGACACAACTGTCCTCATTGAAACCAAACGAGATTATTCCACCGAATTAAGTGTCACCATTGCCGTCGGGGCGTC
GCTCCTCTTCCTCAACATCTTAGCTTTTGCGGCGCTGTACTACAAAAAGGACAAGAGGCGCCATGAGACTCACAG
GCGCCCCAGTCCCCAGAGAACACCACAAATGATATCGCTCACATCCAGAACGAAGAGATCATGTCTCTGCAGAT
GAAGCAGCTGGAACACGATCACGAGTGTGAGTCGCTGCAGGCACACGACACTGAGGCTCACCTGCCCGCCAGA
CTACACCCTCACGCTGCGCCGGTCGCCAGATGACATCCCACTTATGACGCCAAACACCATCACCATGATTCCAAA
CACACTGACGGGGATGCAGCCTTTGCACACTTTTAACACCTTCAGTGGAGGACAAAACAGTACAAATTTACCCCA
CGGACATTCCACCACTAGAGTATAGCTTTGCCCTATTTCCCTTCCTATCCCTCTGCCCTACCCGCTCAGCAACAT
AGAAGAGGGAAGGAAAGAGAGAAGGAAAGAGAGAGAAAGAAAGTCTCCAGACCAGGAATGTTTTTGTCCCACT
GACTTAAGACAAAAATGCAAAAAGGCAGTCATCCCATCCCGGCAGACCCTTATCGTTGGTGTTTTCCAGTATTAC
AAGATCAACTTCTGACCCTGTGAAATGTGAGAAGTACACATTTCTGTTAAAATAACTGCTTTAAGATCTCTACCA
CTCCAATCAATGTTTAGTGTGATAGGACATCACCATTTCAAGGCCCCGGGTGTTTCCAACGTCATGGAAGCAGCT
GACACTTCTGAAACTCAGCCAAGGACACTTGATATTTTTTAATTACAATGGAAGTTTAAACATTTCTTTCTGTGC
CACACAATGGATGGCTCTCCTTAAGTGAAGAAAGAGTCAATGAGATTTTGCCCAGCACATGGAGCTGTAATCCAG
AGAGAAGGAAACGTAGAAATTTATTATTAAAAGAATGGACTGTGCAGCGAAATCTGTACGGTTCTGTGCAAAGAG
GTGTTTTGCCAGCCTGAACTATATTTAAGAGACTTTGT
```

FIGURE 151

MLNSNVLLWLTALAIKFTLIDSQAQYPVVNTNYGKIRGLRTPLPNEILGPVEQYLGVPYASP
PTGERRFQPPEPPSSWTGIRNTTQFAAVCPQHLDERSLLHDMLPIWFTANLDTLMTYVQDQN
EDCLYLNIYVPTEDGANTKKNADDITSNDRGEDEDIHDQNSKKPVMVYIHGGSYMEGTGNMI
DGSILASYGNVIVITINYRLGILGFLSTGDQAAKGNYGLLDQIQALRWIEENVGAFGGDPKR
VTIFGSGAGASCVSLLTLSHYSEGLFQKAIIQSGTALSSWAVNYQPAKYTRILADKVGCNML
DTTDMVECLRNKNYKELIQQTITPATYHIAFGPVIDGDVIPDDPQILMEQGEFLNYDIMLGV
NQGEGLKFVDGIVDNEDGVTPNDFDFSVSNFVDNLYGYPEGKDTLRETIKFMYTDWADKENP
ETRRKTLVALFTDHQWVAPAVAADLHAQYGSPTYFYAFYHHCQSEMKPSWADSAHGDEVPYV
FGIPMIGPTELFSCNFSKNDVMLSAVVMTYWTNFAKTGDPNQPVPQDTKFIHTKPNRFEEVA
WSKYNPKDQLYLHIGLKPRVRDHYRATKVAFWLELVPHLHNLNEIFQYVSTTTKVPPPDMTS
FPYGTRRSPAKIWPTTKRPAITPANNPKHSKDPHKTGPEDTTVLIETKRDYSTELSVTIAVG
ASLLFLNILAFAALYYKKDKRRHETHRRPSPQRNTTNDIAHIQNEEIMSLQMKQLEHDHECE
SLQAHDTLRLTCPPDYTLTLRRSPDDIPLMTPNTITMIPNTLTGMQPLHTFNTFSGGQNSTN
LPHGHSTTRV

Signal sequence:
amino acids 1-24

Transmembrane domains:
amino acids 189-204, 675-692

FIGURE 152

```
GGGAAAGATGGCGGCGACTCTGGGACCCCTTGGGTCGTGGCAGCAGTGGCGGCGATGTTTGT
CGGCTCGGGATGGGTCCAGGATGTTACTCCTTCTTCTTTTGTTGGGGTCTGGGCAGGGGCCA
CAGCAAGTCGGGGCGGGTCAAACGTTCGAGTACTTGAAACGGGAGCACTCGCTGTCGAAGCC
CTACCAGGGTGTGGGCACAGGCAGTTCCTCACTGTGGAATCTGATGGGCAATGCCATGGTGA
TGACCCAGTATATCCGCCTTACCCCAGATATGCAAAGTAAACAGGGTGCCTTGTGGAACCGG
GTGCCATGTTTCCTGAGAGACTGGGAGTTGCAGGTGCACTTCAAAATCCATGGACAAGGAAA
GAAGAATCTGCATGGGGATGGCTTGGCAATCTGGTACACAAAGGATCGGATGCAGCCAGGGC
CTGTGTTTGGAAACATGGACAAATTTGTGGGGCTGGGAGTATTTGTAGACACCTACCCCAAT
GAGGAGAAGCAGCAAGAGCGGGTATTCCCCTACATCTCAGCCATGGTGAACAACGGCTCCCT
CAGCTATGATCATGAGCGGGATGGGCGGCCTACAGAGCTGGGAGGCTGCACAGCCATTGTCC
GCAATCTTCATTACGACACCTTCCTGGTGATTCGCTACGTCAAGAGGCATTTGACGATAATG
ATGGATATTGATGGCAAGCATGAGTGGAGGGACTGCATTGAAGTGCCCGGAGTCCGCCTGCC
CCGCGGCTACTACTTCGGCACCTCCTCCATCACTGGGGATCTCTCAGATAATCATGATGTCA
TTTCCTTGAAGTTGTTTGAACTGACAGTGGAGAGAACCCCAGAAGAGGAAAAGCTCCATCGA
GATGTGTTCTTGCCCTCAGTGGACAATATGAAGCTGCCTGAGATGACAGCTCCACTGCCGCC
CCTGAGTGGCCTGGCCCTCTTCCTCATCGTCTTTTTCTCCCTGGTGTTTTCTGTATTTGCCA
TAGTCATTGGTATCATACTCTACAACAAATGGCAGGAACAGAGCCGAAAGCGCTTCTACTGA
GCCCTCCTGCTGCCACCACTTTTGTGACTGTCACCCATGAGGTATGGAAGGAGCAGGCACTG
GCCTGAGCATGCAGCCTGGAGAGTGTTCTTGTCTCTAGCAGCTGGTTGGGGACTATATTCTG
TCACTGGAGTTTTGAATGCAGGGACCCCGCATTCCCATGGTTGTGCATGGGGACATCTAACT
CTGGTCTGGGAAGCCACCCACCCCAGGGCAATGCTGCTGTGATGTGCCTTTCCCTGCAGTCC
TTCCATGTGGGAGCAGAGGTGTGAAGAGAATTTACGTGGTTGTGATGCCAAAATCACAGAAC
AGAATTTCATAGCCCAGGCTGCCGTGTTGTTTGACTCAGAAGGCCCTTCTACTTCAGTTTTG
AATCCACAAAGAATTAAAAACTGGTAACACCACAGGCTTTCTGACCATCCATTCGTTGGGTT
TTGCATTTGACCCAACCCTCTGCCTACCTGAGGAGCTTTCTTTGGAAACCAGGATGGAAACT
TCTTCCCTGCCTTACCTTCCTTTCACTCCATTCATTGTCCTCTCTGTGTGCAACCTGAGCTG
GGAAAGGCATTTGGATGCCTCTCTGTTGGGGCCTGGGGCTGCAGAACACACCTGCGTTTCAC
TGGCCTTCATTAGGTGGCCCTAGGGAGATGGCTTTCTGCTTTGGATCACTGTTCCCTAGCAT
GGGTCTTGGGTCTATTGGCATGTCCATGGCCTTCCCAATCAAGTCTCTTCAGGCCCTCAGTG
AAGTTTGGCTAAAGGTTGGTGTAAAAATCAAGAGAAGCCTGGAAGACATCATGGATGCCATG
GATTAGCTGTGCAACTGACCAGCTCCAGGTTTGATCAAACCAAAAGCAACATTTGTCATGTG
GTCTGACCATGTGGAGATGTTTCTGGACTTGCTAGAGCCTGCTTAGCTGCATGTTTTGTAGT
TACGATTTTTGGAATCCCACTTTGAGTGCTGAAAGTGTAAGGAAGCTTTCTTCTTACACCTT
GGGCTTGGATATTGCCCAGAGAAGAAATTTGGCTTTTTTTTCTTAATGGACAAGAGACAGT
TGCTGTTCTCATGTTCCAAGTCTGAGAGCAACAGACCCTCATCATCTGTGCCTGGAAGAGTT
CACTGTCATTGAGCAGCACAGCCTGAGTGCTGGCCTCTGTCAACCCTTATTCCACTGCCTTA
TTTGACAAGGGGTTACATGCTGCTCACCTTACTGCCCTGGGATTAAATCAGTTACAGGCCAG
AGTCTCCTTGGAGGGCCTGGAACTCTGAGTCCTCCTATGAACCTCTGTAGCCTAAATGAAAT
TCTTAAAATCACCGATGGAACCAAAAAAAAAAAAAAAAGGGCGGCCGCGACTCTAGAGTCG
ACCTGCAGTAGGGATAACAGGGTAATAAGCTTGGCCGCCATGG
```

FIGURE 153

></usr/seqdb2/sst/DNA/Dnaseqs.min/ss.DNA50911
><subunit 1 of 1, 348 aa, 1 stop
><MW: 39711, pI: 8.70, NX(S/T): 1
MAATLGPLGSWQQWRRCLSARDGSRMLLLLLLLGSGQGPQQVGAGQTFEYLKREHSLSKPYQ
GVGTGSSSLWNLMGNAMVMTQYIRLTPDMQSKQGALWNRVPCFLRDWELQVHFKIHGQGKKN
LHGDGLAIWYTKDRMQPGPVFGNMDKFVGLGVFVDTYPNEEKQQERVFPYISAMVNNGSLSY
DHERDGRPTELGGCTAIVRNLHYDTFLVIRYVKRHLTIMMDIDGKHEWRDCIEVPGVRLPRG
YYFGTSSITGDLSDNHDVISLKLFELTVERTPEEEKLHRDVFLPSVDNMKLPEMTAPLPPLS
GLALFLIVFFSLVFSVFAIVIGIILYNKWQEQSRKRFY

Signal sequence:
amino acids 1-38

Transmembrane domain:
amino acids 310-329

FIGURE 154

```
CCGAGCCGGGCGCGCAGCGACGGAGCTGGGGCCGGCCTGGGACCATGGGCGTGAGTGCAATCTACGGATCAGTCT
CTGATGGTGGGTCGTTAACCTCAGTGGGGACTCCAAGATTTCCATGAAGAAAATCAGTTGTCTTCATTCAAGAAT
TGGGGTCTGGCTCAGAATTCCTGCAGCTGGTGAAAATCTGTTTTCTAGAAGAGGTTTAATTAATGCCTGCAGTCT
GACATGTTCCCGATTTGAGGTGAAACCATGAAGAGAAATAGAATACTTAATAATGCTTTTCCGCAACCGCTTCT
TGCTGCTGCTGGCCCTGGCTGCGCTGCTGGCCTTTGTGAGCCTCAGCCTGCAGTTCTTCCACCTGATCCCGGTGT
CGACTCCTAAGAATGGAATGAGTAGCAAGAGTCGAAAGAGAATCATGCCCGACCCTGTGACGGAGCCCCCTGTGA
CAGACCCCGTTTATGAAGCTCTTTTGTACTGCAACATCCCCAGTGTGGCCGAGCGCAGCATGGAAGGTCATGCCC
CGCATCATTTTAAGCTGGTCTCAGTGCATGTGTTCATTCGCCACGGAGACAGGTACCCACTGTATGTCATTCCCA
AAACAAAGCGACCAGAAATTGACTGCACTCTGGTGGCTAACAGGAAACCGTATCACCCAAAACTGGAAGCTTTCA
TTAGTCACATGTCAAAAGGATCCGGAGCCTCTTTCGAAAGCCCCTTGAACTCCTTGCCTCTTTACCCAAATCACC
CATTGTGTGAGATGGGAGAGCTCACACAGACAGGAGTTGTGCAGCATTTGCAGAACGGTCAGCTGCTGAGGGATA
TCTATCTAAAGAAACACAAACTCCTGCCCAATGATTGGTCTGCAGACCAGCTCTATTTAGAGACCACTGGGAAAA
GCCGGACCCTACAAAGTGGGCTGGCCTTGCTTTATGGCTTTCTCCCAGATTTTGACTGGAAGAAGATTTATTTCA
GGCACCAGCCAAGTGCGCTGTTCTGCTCTGGAAGCTGCTATTGCCCGGTAAGAAACCAGTATCTGGAAAAGGAGC
AGCGTCGTCAGTACCTCCTACGTTTGAAAAACAGCCAGCTGGAGAAGACCTACGGGGAGATGGCCAAGATCGTGG
ATGTCCCCACCAAGCAGCTTAGAGCTGCCAACCCCATAGACTCCATGCTCTGCCACTTCTGCCACAATGTCAGCT
TTCCCTGTACCAGAAATGGCTGTGTTGACATGGAGCACTTCAAGGTAATTAAGACCCATCAGATCGAGGATGAAA
GGGAAAGACGGGAGAAGAAATTGTACTTCGGGTATTCTCTCCTGGGTGCCCACCCCATCCTGAACCAAACCATCG
GCCGGATGCAGCGTGCCACCGAGGGCAGGAAAGAAGAGCTCTTTGCCCTCTACTCTGCTCATGATGTCACTCTGT
CACCAGTTCTCAGTGCCTTGGGCCTTTCAGAAGCCAGGTTCCCAAGGTTTGCAGCCAGGTTGATCTTTGAGCTTT
GGCAAGACAGAGAAAAGCCCAGTGAACATTCCGTCCGGATTCTTTACAATGGCGTCGATGTCACATTCCACACCT
CTTTCTGCCAAGACCACCACAAGCGTTCTCCCAAGCCCATGTGCCCGCTTGAAAACTTGGTCCGCTTTGTGAAAA
GGGACATGTTTGTAGCCCTGGGTGGCAGTGGTACAAATTATTATGATGCATGTCACAGGGAAGGATTCTAAAAGG
TATGCAGTACAGCAGTATAGAATCCATGCCAATACAGAGCATAGGGAAAGGTCCACTTCTAGTTTTGTCTGTTAC
TAAGGGTAGAAGATTATTGCTTTTTAAAGGCTAAATATTGTTTGTGGGAACCACAGATGGTTGGGGTTGAACAGT
AAGCACATTGCTGCAATGTGGTACGTGAATTGCTTGGTACAAAATGGCCAGTTCACAGAGGAATAGAAGGTACTT
TATCATAGCCAGACTTCGCTTAGAATGCCAGAATAATATAGTTCAAGACCTGAAGTTGCCAATCCAAGTTTGCAC
TCTTCTGGCCTGCCCCATGTTACTATGTGATGGAACCAGCACACCTCAACCAAAATTTTTTAATCTTAGACATT
TTTACCTTGTCCTTGTTAAGAATTTCTTGAAGTGATTTATCTAAAATAAAGGTTGGCAAACTTTTTCTGTAAAGG
GCCAGATTGTAAATATTTCAGACTGTGTGGACCAAAAGGCCACATACAGTCTCTGTCATAACTACTCAACTCTGT
TTCTGAAGCAGGAAAGCCACCACAGACAGTACATAAAGGAATATGTGTAGCTGGGTTCCCAGGCCAGACAAAACA
GATGGTGACCAGACTTGGCCCCTGGGCTGTAGTTTGCTGACCCCTCATCTAAAAAATAGGCTATACTACAATTGC
ACTTCCAGCACTTTGAGAACGAGTTGAATACCAAGAATTATTCAATGGTTCCTCCAGTAACTTCTGCTAGAAACA
CAGAATTTGGTCTGTATCTGACACTAGAACAAAACTTGAGGGTAAATAAACATTGAATTAGAATGAATCATAGAA
AACTGATTAGAAGAATACTTGATGTTTATGATGATTGTGGTACAAGATAGTTTTAAGTATGTTCTAAATATTTGT
CTGCTGTAGTCTATTTGCTGTATATGCTGAAATTTTTGTATGCCATTTAGTATTTTATAGTTTAGGAAAATATT
TTCTAAGACCAGTTTTAGATGACTCTTATTCCTGTAGTAATATTCAATTTGCTGTACCTGCTTGGTGGTTAGAAG
GAGGCTAGAAGATGAATTCAGGCACTTTCTTCCAATAAAACTAATTATGGCTCATTCCCTTTGACAAGCTGTAGA
ACTGGATTCATTTTAAACCATTTTCATCAGTTTCAAATGGTAAATTCTGATTGATTTTAAATGCGTTTTTGGA
AGAACTTTGCTATTAGGTAGTTTACAGATCTTTATAAGGTGTTTTATATATTAGAAGCAATTATAATTACATCTG
TGATTTCTGAACTAATGGTGCTAATTCAGAGAAATGGAAAGTGAAAGTGAGATTCTCTGTTGTCATCGGCATTCC
AACTTTTTCTCTTTGTTTTTGTCCAGTGTTGCATTTGAATATGTCTGTTTCTATAAATAAATTTTTTAAGAATAA
```

FIGURE 155

></usr/seqdb2/sst/DNA/Dnaseqs.min/ss.DNA48329
><subunit 1 of 1, 480 aa, 1 stop
><MW: 55240, pI: 9.30, NX(S/T): 2
MLFRNRFLLLLALAALLAFVSLSLQFFHLIPVSTPKNGMSSKSRKRIMPDPVTEPPVTDPVY
EALLYCNIPSVAERSMEGHAPHHFKLVSVHVFIRHGDRYPLYVIPKTKRPEIDCTLVANRKP
YHPKLEAFISHMSKGSGASFESPLNSLPLYPNHPLCEMGELTQTGVVQHLQNGQLLRDIYLK
KHKLLPNDWSADQLYLETTGKSRTLQSGLALLYGFLPDFDWKKIYFRHQPSALFCSGSCYCP
VRNQYLEKEQRRQYLLRLKNSQLEKTYGEMAKIVDVPTKQLRAANPIDSMLCHFCHNVSFPC
TRNGCVDMEHFKVIKTHQIEDERERREKKLYFGYSLLGAHPILNQTIGRMQRATEGRKEELF
ALYSAHDVTLSPVLSALGLSEARFPRFAARLIFELWQDREKPSEHSVRILYNGVDVTFHTSF
CQDHHKRSPKPMCPLENLVRFVKRDMFVALGGSGTNYYDACHREGF

Signal sequence:
amino acids 1-18

FIGURE 156

```
AAAAAAGCTCACTAAAGTTTCTATTAGAGCGAATACGGTAGATTTCCATCCCCTTTTGAAGAACAGTACTGTGGA
GCTATTTAAGAGATAAAAACGAAATATCCTTTCTGGGAGTTCAAGATTGTGCAGTAATTGGTTAGGACTCTGAGC
GCCGCTGTTCACCAATCGGGGAGAGAAAAGCGGAGATCCTGCTCGCCTTGCACGCGCCTGAAGCACAAAGCAGAT
AGCTAGGAATGAACCATCCCTGGGAGTATGTGGAAACAACGGAGGAGCTCTGACTTCCCAACTGTCCCATTCTAT
GGGCGAAGGAACTGCTCCTGACTTCAGTGGTTAAGGGCAGAATTGAAAATAATTCTGGAGGAAGATAAGAATGAT
TCCTGCGCGACTGCACCGGGACTACAAAGGGCTTGTCCTGCTGGGAATCCTCCTGGGGACTCTGTGGGAGACCGG
ATGCACCCAGATACGCTATTCAGTTCCGGAAGAGCTGGAGAAAGGCTCTAGGGTGGGCGACATCTCCAGGGACCT
GGGGCTGGAGCCCCGGGAGCTCGCGGAGCGCGGAGTCCGCATCATCCCCAGAGGTAGGACGCAGCTTTTCGCCCT
GAATCCGCGCAGCGGCAGCTTGGTCACGGCGGGCAGGATAGACCGGGAGGAGCTCTGTATGGGGGCCATCAAGTG
TCAATTAAATCTAGACATTCTGATGGAGGATAAAGTGAAAATATATGGAGTAGAAGTAGAAGTAAGGGACATTAA
CGACAATGCGCCTTACTTTCGTGAAAGTGAATTAGAAATAAAAATTAGTGAAAATGCAGCCACTGAGATGCGGTT
CCCTCTACCCCACGCCTGGGATCCGGATATCGGGAAGAACTCTCTGCAGAGCTACGAGCTCAGCCCGAACACTCA
CTTCTCCCTCATCGTGCAAAATGGAGCCGACGGTAGTAAGTACCCCGAATTGGTGCTGAAACGCGCCCTGGACCG
CGAAGAAAAGGCTGCTCACCACCTGGTCCTTACGGCCTCCGACGGGGGCGACCCGGTGCGCACAGGCACCGCGCG
CATCCGCGTGATGGTTCTGGATGCGAACGACAACGCACCAGCGTTTGCTCAGCCCGAGTACCGCGCGAGCGTTCC
GGAGAATCTGGCCTTGGGCACGCAGCTGCTTGTAGTCAACGCTACCGACCCTGACGAAGGAGTCAATGCGGAAGT
GAGGTATTCCTTCCGGTATGTGGACGACAAGGCGGCCCAAGTTTTCAAACTAGATTGTAATTCAGGGACAATATC
AACAATAGGGGAGTTGGACCACGAGGAGTCAGGATTCTACCAGATGGAAGTGCAAGCAATGGATAATGCAGGATA
TTCTGCGCGAGCCAAAGTCCTGATCACTGTTCTGGACGTGAACGACAATGCCCCAGAAGTGGTCCTCACCTCTCT
CGCCAGCTCGGTTCCCGAAAACTCTCCCAGAGGGACATTAATTGCCCTTTTAAATGTAAATGACCAAGATTCTGA
GGAAAACGGACAGGTGATCTGTTTCATCCAAGGAAATCTGCCCTTTAAATTAGAAAAATCTTACGGAAATTACTA
TAGTTTAGTCACAGACATAGTCTTGGATAGGGAACAGGTTCCTAGCTACAACATCACAGTGACCGCCACTGACCG
GGGAACCCCGCCCCTATCCACGGAAACTCATATCTCGCTGAACGTGGCAGACACCAACGACAACCCGCCGGTCTT
CCCTCAGGCCTCCTATTCCGCTTATATCCCAGAGAACAATCCCAGAGGAGTTTCCCTCGTCTCTGTGACCGCCCA
CGACCCCGACTGTGAAGAGAACGCCCAGATCACTTATTCCCTGGCTGAGAACACCATCCAAGGGCAAGCCTATC
GTCCTACGTGTCCATCAACTCCGACACTGGGGTACTGTATGCGCTGAGCTCCTTCGACTACGAGCAGTTCCGAGA
CTTGCAAGTGAAAGTGATGGCGCGGGACAACGGGCACCCGCCCCTCAGCAGCAACGTGTCGTTGAGCCTGTTCGT
GCTGGACCAGAACGACAATGCGCCCGAGATCCTGTACCCCGCCCTCCCCACGGACGGTTCCACTGGCGTGGAGCT
GGCTCCCCGCTCCGCAGAGCCCGGCTACCTGGTGACCAAGGTGGTGGCGGTGGACAGAGACTCCGGCCAGAACGC
CTGGCTGTCCTACCGTCTGCTCAAGGCCAGCGAGCCGGGACTCTTCTCGGTGGGTCTGCACACGGGCGAGGTGCG
CACGGCGCGAGCCCTGCTGGACAGAGACGCGCTCAAGCAGAGCCTCGTAGTGGCCGTCCAGGACCACGGCCAGCC
CCCTCTCTCCGCCACTGTCACGCTCACCGTGGCCGTGGCCGACAGCATCCCCCAAGTCCTGGCGGACCTCGGCAG
CCTCGAGTCTCCAGCTAACTCTGAAACCTCAGACCTCACTCTGTACCTGGTGGTAGCGGTGGCCGCGGTCTCCTG
CGTCTTCCTGGCCTTCGTCATCTTGCTGCTGGCGCTCAGGCTGCGGCGCTGGCACAAGTCACGCCTGCTGCAGGC
TTCAGGAGGCGGCTTGACAGGAGCGCCGGCGTCGCACTTTGTGGGCGTGGACGGGGTGCAGGCTTTCCTGCAGAC
CTATTCCCACGAGGTTTCCCTCACCACGGACTCGCGGAAGAGTCACCTGATCTTCCCCCAGCCCAACTATGCAGA
CATGCTCGTCAGCCAGGAGAGCTTTGAAAAAAGCGAGCCCCTTTTGCTGTCAGGTGATTCGGTATTTTCTAAAGA
CAGTCATGGGTTAATTGAGGTGAGTTTATATCAAATCTTCTTTCTTTTTTTTTTAATTGCTCTGTCTCCCAAGC
TGGAGTGCAGCGGTACGATCATAGCTCACTGCGGCCTCAAACTCCTAGGCTCAAGCAATTATCCCACCTTTGCCT
CCGGTGTAACAGGGACTACAGGTGCAAGCCACCTACTGTCTGCCTATCTATCTATCTATCTATCTATCTATCTAT
CTATCTATCTATCTATCTATTACTTTCTTGTACAGACGGGAGTCTCACGCCTGTAATCCCAGTACTTTGGGAGGC
CGAGGCGGGTGGATCACCTGAGGTTGGGAGTTTGAGACCAGCCTGACCAACATGGAGAAACCCCGTCTATACTAA
AAAAATACAAAATTAGCCGGGCGTGGTGGTGCATGTCTGTAATCCCAGCTACTTGGGAGGCTGAGTCAGGAGAAT
TGCTTTAACCTGGGAGGTGGAGGTTGCAATGAGCTGAGATTGTGCCATTGCACTCCAGCCTGGGCAACAAGAGTG
AAACTCTATCTCA
```

FIGURE 157

></usr/seqdb2/sst/DNA/Dnaseqs.min/ss.DNA48306
><subunit 1 of 1, 916 aa, 1 stop
><MW: 100204, pI: 4.92, NX(S/T): 4

MIPARLHRDYKGLVLLGILLGTLWETGCTQIRYSVPEELEKGSRVGDISRDLGLEPRELAER
GVRIIPRGRTQLFALNPRSGSLVTAGRIDREELCMGAIKCQLNLDILMEDKVKIYGVEVEVR
DINDNAPYFRESELEIKISENAATEMRFPLPHAWDPDIGKNSLQSYELSPNTHFSLIVQNGA
DGSKYPELVLKRALDREEKAAHHLVLTASDGGDPVRTGTARIRVMVLDANDNAPAFAQPEYR
ASVPENLALGTQLLVVNATDPDEGVNAEVRYSFRYVDDKAAQVFKLDCNSGTISTIGELDHE
ESGFYQMEVQAMDNAGYSARAKVLITVLDVNDNAPEVVLTSLASSVPENSPRGTLIALLNVN
DQDSEENGQVICFIQGNLPFKLEKSYGNYYSLVTDIVLDREQVPSYNITVTATDRGTPPLST
ETHISLNVADTNDNPPVFPQASYSAYIPENNPRGVSLVSVTAHDPDCEENAQITYSLAENTI
QGASLSSYVSINSDTGVLYALSSFDYEQFRDLQVKVMARDNGHPPLSSNVSLSLFVLDQNDN
APEILYPALPTDGSTGVELAPRSAEPGYLVTKVVAVDRDSGQNAWLSYRLLKASEPGLFSVG
LHTGEVRTARALLDRDALKQSLVVAVQDHGQPPLSATVTLTVAVADSIPQVLADLGSLESPA
NSETSDLTLYLVVAVAAVSCVFLAFVILLLALRLRRWHKSRLLQASGGGLTGAPASHFVGVD
GVQAFLQTYSHEVSLTTDSRKSHLIFPQPNYADMLVSQESFEKSEPLLLSGDSVFSKDSHGL
IEVSLYQIFFLFFFNCSVSQAGVQRYDHSSLRPQTPRLKQLSHLCLRCNRDYRCKPPTVCLS
IYLSIYLSIYLSIYLLLSCTDGSLTPVIPVLWEAEAGGSPEVGSLRPA

Signal sequence:

amino acids 1-30

Transmembrane domains:

amino acids 693-711, 809-823, 869-888

FIGURE 158

CCCAGGCTCTAGTGCAGGAGGAGAAGGAGGAGGAGCAGGAGGTGGAGATTCCCAGTTAAAAG
GCTCCAGAATCGTGTACCAGGCAGAGAACTGAAGTACTGGGGCCTCCTCCACTGGGTCCGAA
TCAGTAGGTGACCCCGCCCCTGGATTCTGGAAGACCTCACCATGGGACGCCCCGACCTCGT
GCGGCCAAGACGTGGATGTTCCTGCTCTTGCTGGGGGGAGCCTGGGCAGGACACTCCAGGGC
ACAGGAGGACAAGGTGCTGGGGGGTCATGAGTGCCAACCCCATTCGCAGCCTTGGCAGGCGG
CCTTGTTCCAGGGCCAGCAACTACTCTGTGGCGGTGTCCTTGTAGGTGGCAACTGGGTCCTT
ACAGCTGCCCACTGTAAAAAACCGAAATACACAGTACGCCTGGGAGACCACAGCCTACAGAA
TAAAGATGGCCCAGAGCAAGAAATACCTGTGGTTCAGTCCATCCCACACCCCTGCTACAACA
GCAGCGATGTGGAGGACCACAACCATGATCTGATGCTTCTTCAACTGCGTGACCAGGCATCC
CTGGGGTCCAAAGTGAAGCCCATCAGCCTGGCAGATCATTGCACCCAGCCTGGCCAGAAGTG
CACCGTCTCAGGCTGGGGCACTGTCACCAGTCCCCGAGAGAATTTTCCTGACACTCTCAACT
GTGCAGAAGTAAAAATCTTTCCCCAGAAGAAGTGTGAGGATGCTTACCCGGGGCAGATCACA
GATGGCATGGTCTGTGCAGGCAGCAGCAAAGGGGCTGACACGTGCCAGGGCGATTCTGGAGG
CCCCCTGGTGTGTGATGGTGCACTCCAGGGCATCACATCCTGGGGCTCAGACCCCTGTGGGA
GGTCCGACAAACCTGGCGTCTATACCAACATCTGCCGCTACCTGGACTGGATCAAGAAGATC
ATAGGCAGCAAGGGCTGATTCTAGGATAAGCACTAGATCTCCCTTAATAAACTCACAACTCT
CTGGTTC

FIGURE 159

</usr/seqdb2/sst/DNA/Dnaseqs.min/ss.DNA48336
<subunit 1 of 1, 260 aa, 1 stop
<MW: 28048, pI: 7.87, NX(S/T): 1

MGRPRPRAAKTWMFLLLLGGAWAGHSRAQEDKVLGGHECQPHSQPWQAALFQGQQLLCGGVL
VGGNWVLTAAHCKKPKYTVRLGDHSLQNKDGPEQEIPVVQSIPHPCYNSSDVEDHNHDLMLL
QLRDQASLGSKVKPISLADHCTQPGQKCTVSGWGTVTSPRENFPDTLNCAEVKIFPQKKCED
AYPGQITDGMVCAGSSKGADTCQGDSGGPLVCDGALQGITSWGSDPCGRSDKPGVYTNICRY
LDWIKKIIGSKG

Important Features:

Signal peptide:

amino acids 1-23

Transmembrane domain:

amino acids 51-71

N-glycosylation site.

amino acids 110-113

Serine proteases, trypsin family, histidine active site.

amino acids 69-74 and 207-217

Tyrosine kinase phosphorylation site.

amino acids 182-188

Kringle domain proteins motif amino acids 205-217

FIGURE 160

```
GGCGCCGGTGCACCGGGCGGGCTGAGCGCCTCCTGCGGCCCGGCCTGCGCGCCCCGGCCCGC
CGCGCCGCCCACGCCCCAACCCCGGCCCGCGCCCCTAGCCCCCGCCCGGGCCCGCGCCCGC
GCCCGCGCCCAGGTGAGCGCTCCGCCCGCCGCGAGGCCCCGCCCCGGCCCGCCCCCGCCCCG
CCCCGGCCGGCGGGGGAACCGGGCGGATTCCTCGCGCGTCAAACCACCTGATCCCATAAAAC
ATTCATCCTCCCGGCGGCCCGCGCTGCGAGCGCCCCGCCAGTCCGCGCCGCCGCCGCCCTCG
CCCTGTGCGCCCTGCGCGCCCTGCGCACCCGCGGCCCGAGCCCAGCCAGAGCCGGGCGGAGC
GGAGCGCGCCGAGCCTCGTCCCGCGGCCGGGCCGGGGCCGGGCCGTAGCGGCGGCGCCTGGA
TGCGGACCCGGCCGCGGGGAGACGGGCGCCCGCCCCGAAACGACTTTCAGTCCCCGACGCGC
CCCGCCCAACCCCTACGATGAAGAGGGCGTCCGCTGGAGGGAGCCGGCTGCTGGCATGGGTG
CTGTGGCTGCAGGCCTGGCAGGTGGCAGCCCCATGCCCAGGTGCCTGCGTATGCTACAATGA
GCCCAAGGTGACGACAAGCTGCCCCAGCAGGGCCTGCAGGCTGTGCCCGTGGGCATCCCTG
CTGCCAGCCAGCGCATCTTCCTGCACGGCAACCGCATCTCGCATGTGCCAGCTGCCAGCTTC
CGTGCCTGCCGCAACCTCACCATCCTGTGGCTGCACTCGAATGTGCTGGCCCGAATTGATGC
GGCTGCCTTCACTGGCCTGGCCCTCCTGGAGCAGCTGGACCTCAGCGATAATGCACAGCTCC
GGTCTGTGGACCCTGCCACATTCCACGGCCTGGGCCGCCTACACACGCTGCACCTGGACCGC
TGCGGCCTGCAGGAGCTGGGCCCGGGGCTGTTCCGCGGCCTGGCTGCCCTGCAGTACCTCTA
CCTGCAGGACAACGCGCTGCAGGCACTGCCTGATGACACCTTCCGCGACCTGGGCAACCTCA
CACACCTCTTCCTGCACGGCAACCGCATCTCCAGCGTGCCCGAGCGCGCCTTCCGTGGGCTG
CACAGCCTCGACCGTCTCCTACTGCACCAGAACGCGTGGCCCATGTGCACCCGCATGCCTT
CCGTGACCTTGGCCGCCTCATGACACTCTATCTGTTTGCCAACAATCTATCAGCGCTGCCCA
CTGAGGCCCTGGCCCCCCTGCGTGCCCTGCAGTACCTGAGGCTCAACGACAACCCCTGGGTG
TGTGACTGCCGGGCACGCCCACTCTGGGCCTGGCTGCAGAAGTTCCGCGGCTCCTCCTCCGA
GGTGCCCTGCAGCCTCCCGCAACGCCTGGCTGGCCGTGACCTCAAACGCCTAGCTGCCAATG
ACCTGCAGGGCTGCGCTGTGGCCACCGGCCCTTACCATCCCATCTGGACCGGCAGGGCCACC
GATGAGGAGCCGCTGGGGCTTCCCAAGTGCTGCCAGCCAGATGCCGCTGACAAGGCCTCAGT
ACTGGAGCCTGGAAGACCAGCTTCGGCAGGCAATGCGCTGAAGGGACGCGTGCCGCCCGGTG
ACAGCCCGCCGGGCAACGGCTCTGGCCCACGGCACATCAATGACTCACCCTTTGGGACTCTG
CCTGGCTCTGCTGAGCCCCCGCTCACTGCAGTGCGGCCCGAGGGCTCCGAGCCACCAGGGTT
CCCCACCTCGGGCCCTCGCCGGAGGCCAGGCTGTTCACGCAAGAACCGCACCCGCAGCCACT
GCCGTCTGGGCCAGGCAGGCAGCGGGGTGGCGGGACTGGTGACTCAGAAGGCTCAGGTGCC
CTACCCAGCCTCACCTGCAGCCTCACCCCCTGGGCCTGGCGCTGGTGCTGTGGACAGTGCT
TGGGCCCTGCTGACCCCCAGCGGACACAAGAGCGTGCTCAGCAGCCAGGTGTGTGTACATAC
GGGGTCTCTCTCCACGCCGCCAAGCCAGCCGGGCGGCCGACCCGTGGGGCAGGCCAGGCCAG
GTCCTCCCTGATGGACGCCTGCCGCCCGCCACCCCATCTCCACCCCATCATGTTTACAGGG
TTCGGCGGCAGCGTTTGTTCCAGAACGCCGCCTCCCACCCAGATCGCGGTATATAGAGATAT
GCATTTTATTTTACTTGTGTAAAAATATCGGACGACGTGGAATAAAGAGCTCTTTTCTTAAA
AAAA
```

FIGURE 161

></usr/seqdb2/sst/DNA/Dnaseqs.min/ss.DNA44184
><subunit 1 of 1, 473 aa, 1 stop
><MW: 50708, pI: 9.28, NX(S/T): 6

MKRASAGGSRLLAWVLWLQAWQVAAPCPGACVCYNEPKVTTSCPQQGLQAVPVGIPAASQRI
FLHGNRISHVPAASFRACRNLTILWLHSNVLARIDAAAFTGLALLEQLDLSDNAQLRSVDPA
TFHGLGRLHTLHLDRCGLQELGPGLFRGLAALQYLYLQDNALQALPDDTFRDLGNLTHLFLH
GNRISSVPERAFRGLHSLDRLLLHQNRVAHVHPHAFRDLGRLMTLYLFANNLSALPTEALAP
LRALQYLRLNDNPWVCDCRARPLWAWLQKFRGSSSEVPCSLPQRLAGRDLKRLAANDLQGCA
VATGPYHPIWTGRATDEEPLGLPKCCQPDAADKASVLEPGRPASAGNALKGRVPPGDSPPGN
GSGPRHINDSPFGTLPGSAEPPLTAVRPEGSEPPGFPTSGPRRRPGCSRKNRTRSHCRLGQA
GSGGGGTGDSEGSGALPSLTCSLTPLGLALVLWTVLGPC

Important features:
Signal peptide:
amino acids 1-26

Leucine zipper pattern.
amino acids 135-156

Glycosaminoglycan attachment site.
amino acids 436-439

N-glycosylation site.
amino acids 82-85, 179-183, 237-240, 372-375 and 423-426

VWFC domain
amino acids 411-425

FIGURE 162

```
GGAAGTCCACGGGGAGCTTGGATGCCAAAGGGAGGACGGCTGGGTCCTCTGGAGAGGACTAC
TCACTGGCATATTTCTGAGGTATCTGTAGAATAACCACAGCCTCAGATACTGGGGACTTTAC
AGTCCCACAGAACCGTCCTCCCAGGAAGCTGAATCCAGCAAGAACAATGGAGGCCAGCGGGA
AGCTCATTTGCAGACAAAGGCAAGTCCTTTTTTCCTTTCTCCTTTTGGGCTTATCTCTGGCG
GGCGCGGCGGAACCTAGAAGCTATTCTGTGGTGGAGGAAACTGAGGGCAGCTCCTTTGTCAC
CAATTTAGCAAAGGACCTGGGTCTGGAGCAGAGGGAATTCTCCAGGCGGGGGGTTAGGGTTG
TTTCCAGAGGGAACAAACTACATTTGCAGCTCAATCAGGAGACCGCGGATTTGTTGCTAAAT
GAGAAATTGGACCGTGAGGATCTGTGCGGTCACACAGAGCCCTGTGTGCTACGTTTCCAAGT
GTTGCTAGAGAGTCCCTTCGAGTTTTTTCAAGCTGAGCTGCAAGTAATAGACATAAACGACC
ACTCTCCAGTATTTCTGGACAAACAAATGTTGGTGAAAGTATCAGAGAGCAGTCCTCCTGGG
ACTACGTTTCCTCTGAAGAATGCCGAAGACTTAGATGTAGGCCAAAACAATATTGAGAACTA
TATAATCAGCCCCAACTCCTATTTTCGGGTCCTCACCCGCAAACGCAGTGATGGCAGGAAAT
ACCCAGAGCTGGTGCTGGACAAAGCGCTGGACCGAGAGGAAGAAGCTGAGCTCAGGTTAACA
CTCACAGCACTGGATGGTGGCTCTCCGCCCAGATCTGGCACTGCTCAGGTCTACATCGAAGT
CCTGGATGTCAACGATAATGCCCCTGAATTTGAGCAGCCTTTCTATAGAGTGCAGATCTCTG
AGGACAGTCCGGTAGGCTTCCTGGTTGTGAAGGTCTCTGCCACGGATGTAGACACAGGAGTC
AACGGAGAGATTTCCTATTCACTTTTCCAAGCTTCAGAAGAGATTGGCAAAACCTTTAAGAT
CAATCCCTTGACAGGAGAAATTGAACTAAAAAAACAACTCGATTTCGAAAAACTTCAGTCCT
ATGAAGTCAATATTGAGGCAAGAGATGCTGGAACCTTTTCTGGAAAATGCACCGTTCTGATT
CAAGTGATAGATGTGAACGACCATGCCCCAGAAGTTACCATGTCTGCATTTACCAGCCCAAT
ACCTGAGAACGCGCCTGAAACTGTGGTTGCACTTTTCAGTGTTTCAGATCTTGATTCAGGAG
AAAATGGGAAAATTAGTTGCTCCATTCAGGAGGATCTACCCTTCCTCCTGAAATCCGCGGAA
AACTTTTACACCCTACTAACGGAGAGACCACTAGACAGAGAAAGCAGAGCGGAATACAACAT
CACTATCACTGTCACTGACTTGGGGACCCCTATGCTGATAACACAGCTCAATATGACCGTGC
TGATCGCCGATGTCAATGACAACGCTCCCGCCTTCACCCAAACCTCCTACACCCTGTTCGTC
CGCGAGAACAACAGCCCCGCCCTGCACATCCGCAGCGTCAGCGCTACAGACAGAGACTCAGG
CACCAACGCCCAGGTCACCTACTCGCTGCTGCCGCCCCAGGACCCGCACCTGCCCCTCACAT
CCCTGGTCTCCATCAACGCGGACAACGGCCACCTGTTCGCCCTCAGGTCTCTGGACTACGAG
GCCCTGCAGGGGTTCCAGTTCCGCGTGGGCGCTTCAGACCACGGCTCCCCGGCGCTGAGCAG
CGAGGCGCTGGTGCGCGTGGTGGTGCTGGACGCCAACGACAACTCGCCCTTCGTGCTGTACC
CGCTGCAGAACGGCTCCGCGCCCTGCACCGAGCTGGTGCCCCGGGCGGCCGAGCCGGGCTAC
CTGGTGACCAAGGTGGTGGCGGTGGACGGCGACTCGGGCCAGAACGCCTGGCTGTCGTACCA
GCTGCTCAAGGCCACGGAGCTCGGTCTGTTCGGCGTGTGGGCGCACAATGGCGAGGTGCGCA
CCGCCAGGCTGCTGAGCGAGCGCGACGCGGCCAAGCACAGGCTGGTGGTGCTGGTCAAGGAC
AATGGCGAGCCTCCGCGCTCGGCCACCGCCACGCTGCACGTGCTCCTGGTGGACGGCTTCTC
CCAGCCCTACCTGCCTCTCCCGGAGGCGGCCCCGACCCAGGCCCAGGCCGACTTGCTCACCG
TCTACCTGGTGGTGGCGTTGGCCTCGGTGTCTTCGCTCTTCCTCTTTTCGGTGCTCCTGTTC
GTGGCGGTGCGGCTGTGTAGGAGGAGCAGGGCGGCCTCGGTGGGTCGCTGCTTGGTGCCCGA
GGGCCCCCTTCCAGGGCATCTTGTGGACATGAGCGGCACCAGGACCCTATCCCAGAGCTACC
AGTATGAGGTGTGTCTGGCAGGAGGCTCAGGGACCAATGAGTTCAAGTTCCTGAAGCCGATT
ATCCCCAACTTCCCTCCCCAGTGCCCTGGGAAAGAAATACAAGGAAATTCTACCTTCCCCAA
TAACTTTGGGTTCAATATTCAGTGACCATAGTTGACTTTTACATTCCATAGGTATTTTATTT
TGTGGCATTTCCATGCCAATGTTTATTTCCCCAATTTGTGTGTATGTAATATTGTACGGAT
TTACTCTTGATTTTTCTCATGTTCTTTCTCCCTTTGTTTTAAAGTGAACATTTACCTTTATT
CCTGGTTCTT
```

FIGURE 163

```
</usr/seqdb2/sst/DNA/Dnaseqs.min/ss.DNA48314
<subunit 1 of 1, 798 aa, 1 stop
<MW: 87552, pI: 4.84, NX(S/T): 5
MEASGKLICRQRQVLFSFLLLGLSLAGAAEPRSYSVVEETEGSSFVTNLAKDLGLEQREFSR
RGVRVVSRGNKLHLQLNQETADLLLNEKLDREDLCGHTEPCVLRFQVLLESPFEFFQAELQV
IDINDHSPVFLDKQMLVKVSESSPPGTTFPLKNAEDLDVGQNNIENYIISPNSYFRVLTRKR
SDGRKYPELVLDKALDREEEAELRLTLTALDGGSPPRSGTAQVYIEVLDVNDNAPEFEQPFY
RVQISEDSPVGFLVVKVSATDVDTGVNGEISYSLFQASEEIGKTFKINPLTGEIELKKQLDF
EKLQSYEVNIEARDAGTFSGKCTVLIQVIDVNDHAPEVTMSAFTSPIPENAPETVVALFSVS
DLDSGENGKISCSIQEDLPFLLKSAENFYTLLTERPLDRESRAEYNITITVTDLGTPMLITQ
LNMTVLIADVNDNAPAFTQTSYTLFVRENNSPALHIRSVSATDRDSGTNAQVTYSLLPPQDP
HLPLTSLVSINADNGHLFALRSLDYEALQGFQFRVGASDHGSPALSSEALVRVVVLDANDNS
PFVLYPLQNGSAPCTELVPRAAEPGYLVTKVVAVDGDSGQNAWLSYQLLKATELGLFGVWAH
NGEVRTARLLSERDAAKHRLVVLVKDNGEPPRSATATLHVLLVDGFSQPYLPLPEAAPTQAQ
ADLLTVYLVVALASVSSLFLFSVLLFVAVRLCRRSRAASVGRCLVPEGPLPGHLVDMSGTRT
LSQSYQYEVCLAGGSGTNEFKFLKPIIPNFPPQCPGKEIQGNSTFPNNFGFNIQ
```

Important features:

Signal peptide:

amino acids 1-26

Transmembrane domain:

amino acids 685-712

Cadherins extracellular repeated domain signature.

amino acids 122-132, 231-241, 336-346, 439-449 and 549-559

ATP/GTP-binding site motif A (P-loop).

amino acids 285-292

N-glycosylation site.

amino acids 418-421, 436-439, 567-570 and 786-789

FIGURE 164

ACCCACGCGTCCGCCCACGCGTCCGCCCACGCGTCCGCCCACGCGTCCGCGCGTAGCCGTGC
GCCGATTGCCTCTCGGCCTGGGCAATGGTCCCGGCTGCCGGTCGACGACCGCCCCGCGTCAT
GCGGCTCCTCGGCTGGTGGCAAGTATTGCTGTGGGTGCTGGGACTTCCCGTCCGCGGCGTGG
AGGTTGCAGAGGAAAGTGGTCGCTTATGGTCAGAGGAGCAGCCTGCTCACCCTCTCCAGGTG
GGGGCTGTGTACCTGGGTGAGGAGGAGCTCCTGCATGACCCGATGGGCCAGGACAGGGCAGC
AGAAGAGGCCAATGCGGTGCTGGGGCTGGACACCCAAGGCGATCACATGGTGATGCTGTCTG
TGATTCCTGGGGAAGCTGAGGACAAAGTGAGTTCAGAGCCTAGCGGCGTCACCTGTGGTGCT
GGAGGAGCGGAGGACTCAAGGTGCAACGTCCGAGAGAGCCTTTTCTCTCTGGATGGCGCTGG
AGCACACTTCCCTGACAGAGAAGAGGAGTATTACACAGAGCCAGAAGTGGCGGAATCTGACG
CAGCCCCGACAGAGGACTCCAATAACACTGAAAGTCTGAAATCCCCAAAGGTGAACTGTGAG
GAGAGAAACATTACAGGATTAGAAAATTTCACTCTGAAAATTTTAAATATGTCACAGGACCT
TATGGATTTTCTGAACCCAAACGGTAGTGACTGTACTCTAGTCCTGTTTTACACCCCGTGGT
GCCGCTTTTCTGCCAGTTTGGCCCCTCACTTTAACTCTCTGCCCCGGGCATTTCCAGCTCTT
CACTTTTTGGCACTGGATGCATCTCAGCACAGCAGCCTTTCTACCAGGTTTGGCACCGTAGC
TGTTCCTAATATTTTATTATTTCAAGGAGCTAAACCAATGGCCAGATTTAATCATACAGATC
GAACACTGGAAACACTGAAAATCTTCATTTTTAATCAGACAGGTATAGAAGCCAAGAAGAAT
GTGGTGGTAACTCAAGCCGACCAAATAGGCCCTCTTCCCAGCACTTTGATAAAAAGTGTGGA
CTGGTTGCTTGTATTTTCCTTATTCTTTTTAATTAGTTTTATTATGTATGCTACCATTCGAA
CTGAGAGTATTCGGTGGCTAATTCCAGGACAAGAGCAGGAACATGTGGAGTAGTGATGGTCT
GAAAGAAGTTGGAAAGAGGAACTTCAATCCTTCGTTTCAGAAATTAGTGCTACAGTTTCATA
CATTTTCTCCAGTGACGTGTTGACTTGAAACTTCAGGCAGATTAAAAGAATCATTTGTTGAA
CAACTGAATGTATAAAAAATTATAAACTGGTGTTTTAACTAGTATTGCAATAAGCAAATGC
AAAAATATTCAATAG

FIGURE 165

></usr/seqdb2/sst/DNA/Dnaseqs.min/ss.DNA48333
><subunit 1 of 1, 360 aa, 1 stop
><MW: 39885, pI: 4.79, NX(S/T): 7

MVPAAGRRPPRVMRLLGWWQVLLWVLGLPVRGVEVAEESGRLWSEEQPAHPLQVGAVYLGEE
ELLHDPMGQDRAAEEANAVLGLDTQGDHMVMLSVIPGEAEDKVSSEPSGVTCGAGGAEDSRC
NVRESLFSLDGAGAHFPDREEEYYTEPEVAESDAAPTEDSNNTESLKSPKVNCEERNITGLE
NFTLKILNMSQDLMDFLNPNGSDCTLVLFYTPWCRFSASLAPHFNSLPRAFPALHFLALDAS
QHSSLSTRFGTVAVPNILLFQGAKPMARFNHTDRTLETLKIFIFNQTGIEAKKNVVVTQADQ
IGPLPSTLIKSVDWLLVFSLFFLISFIMYATIRTESIRWLIPGQEQEHVE

Important features:
Signal peptide:
amino acids 1-25

Transmembrane domain:
amino acids 321-340

Homologous region to dilsufide isomerase
amino acids 212-302

N-glycosylation site.
amino acids 165-168, 181-184, 187-190, 194-197, 206-209, 278-281 and 293-296

Thioredoxin domain
amino acids 211-227

FIGURE 166

```
CCCGGCTCCGCTCCCTCTGCCCCCTCGGGGTCGCGCGCCCACGATGCTGCAGGGCCCTGGCT
CGCTGCTGCTGCTCTTCCTCGCCTCGCACTGCTGCCTGGGCTCGGCGCGCGGGCTCTTCCTC
TTTGGCCAGCCCGACTTCTCCTACAAGCGCAGCAATTGCAAGCCCATCCCGGTCAACCTGCA
GCTGTGCCACGGCATCGAATACCAGAACATGCGGCTGCCCAACCTGCTGGGCCACGAGACCA
TGAAGGAGGTGCTGGAGCAGGCCGGCGCTTGGATCCCGCTGGTCATGAAGCAGTGCCACCCG
GACACCAAGAAGTTCCTGTGCTCGCTCTTCGCCCCCGTCTGCCTCGATGACCTAGACGAGAC
CATCCAGCCATGCCACTCGCTCTGCGTGCAGGTGAAGGACCGCTGCGCCCCGGTCATGTCCG
CCTTCGGCTTCCCCTGGCCCGACATGCTTGAGTGCGACCGTTTCCCCCAGGACAACGACCTT
TGCATCCCCCTCGCTAGCAGCGACCACCTCCTGCCAGCCACCGAGGAAGCTCCAAAGGTATG
TGAAGCCTGCAAAAATAAAAATGATGATGACAACGACATAATGGAAACGCTTTGTAAAAATG
ATTTTGCACTGAAAATAAAAGTGAAGGAGATAACCTACATCAACCGAGATACCAAAATCATC
CTGGAGACCAAGAGCAAGACCATTTACAAGCTGAACGGTGTGTCCGAAAGGGACCTGAAGAA
ATCGGTGCTGTGGCTCAAAGACAGCTTGCAGTGCACCTGTGAGGAGATGAACGACATCAACG
CGCCCTATCTGGTCATGGGACAGAAACAGGGTGGGGAGCTGGTGATCACCTCGGTGAAGCGG
TGGCAGAAGGGGCAGAGAGAGTTCAAGCGCATCTCCCGCAGCATCCGCAAGCTGCAGTGCTA
GTCCCGGCATCCTGATGGCTCCGACAGGCCTGCTCCAGAGCACGGCTGACCATTTCTGCTCC
GGGATCTCAGCTCCCGTTCCCCAAGCACACTCCTAGCTGCTCCAGTCTCAGCCTGGGCAGCT
TCCCCCTGCCTTTTGCACGTTTGCATCCCCAGCATTTCCTGAGTTATAAGGCCACAGGAGTG
GATAGCTGTTTTCACCTAAAGGAAAAGCCCACCCGAATCTTGTAGAAATATTCAAACTAATA
AAATCATGAATATTTTAA
```

FIGURE 167

```
></usr/seqdb2/sst/DNA/Dnaseqs.min/ss.DNA50920
><subunit 1 of 1, 295 aa, 1 stop
><MW: 33518, pI: 7.74, NX(S/T): 0
MLQGPGSLLLLFLASHCCLGSARGLFLFGQPDFSYKRSNCKPIPVNLQLCHGIEYQNMRLPN
LLGHETMKEVLEQAGAWIPLVMKQCHPDTKKFLCSLFAPVCLDDLDETIQPCHSLCVQVKDR
CAPVMSAFGFPWPDMLECDRFPQDNDLCIPLASSDHLLPATEEAPKVCEACKNKNDDDNDIM
ETLCKNDFALKIKVKEITYINRDTKIILETKSKTIYKLNGVSERDLKKSVLWLKDSLQCTCE
EMNDINAPYLVMGQKQGGELVITSVKRWQKGQREFKRISRSIRKLQC
```

Important features:

Signal peptide:
amino acids 1-20

Cysteine rich domain, homolgous to frizzled N terminus
amino acids 6-153

FIGURE 168

GTGGAGGCCGCCGACGATGGCGGGGCCGACGGAGGCCGAGACGGGGTTGGCCGAGCCCCGGG
CCCTGTGCGCGCAGCGGGGCCACCGCACCTACGCGCGCCGCTGGGTGTTCCTGCTCGCGATC
AGCCTGCTCAACTGCTCCAACGCCACGCTGTGGCTCAGCTTTGCACCTGTGGCTGACGTCAT
TGCTGAGGACTTGGTCCTGTCCATGGAGCAGATCAACTGGCTGTCACTGGTCTACCTCGTGG
TATCCACCCCATTTGGCGTGGCGGCCATCTGGATCCTGGACTCCGTCGGGCTCCGTGCGGCG
ACCATCCTGGGTGCGTGGCTGAACTTTGCCGGGAGTGTGCTACGCATGGTGCCCTGCATGGT
TGTTGGGACCCAAAACCCATTTGCCTTCCTCATGGGTGGCCAGAGCCTCTGTGCCCTTGCCC
AGAGCCTGGTCATCTTCTCTCCAGCCAAGCTGGCTGCCTTGTGGTTCCCAGAGCACCAGCGA
GCCACGGCCAACATGCTCGCCACCATGTCGAACCCTCTGGGCGTCCTTGTGGCCAATGTGCT
GTCCCCTGTGCTGGTCAAGAAGGGTGAGGACATTCCGTTAATGCTCGGTGTCTATACCATCC
CTGCTGGCGTCGTCTGCCTGCTGTCCACCATCTGCCTGTGGGAGAGTGTGCCCCCCACCCCG
CCCTCTGCCGGGGCTGCCAGCTCCACCTCAGAGAAGTTCCTGGATGGGCTCAAGCTGCAGCT
CATGTGGAACAAGGCCTATGTCATCCTGGCTGTGTGCTTGGGGGGAATGATCGGGATCTCTG
CCAGCTTCTCAGCCCTCCTGGAGCAGATCCTCTGTGCAAGCGGCCACTCCAGTGGGTTTTCC
GGCCTCTGTGGCGCTCTCTTCATCACGTTTGGGATCCTGGGGCACTGGCTCTCGGCCCCTA
TGTGGACCGGACCAAGCACTTCACTGAGGCCACCAAGATTGGCCTGTGCCTGTTCTCTCTGG
CCTGCGTGCCCTTTGCCCTGGTGTCCCAGCTGCAGGGACAGACCCTTGCCCTGGCTGCCACC
TGCTCGCTGCTCGGGCTGTTTGGCTTCTCGGTGGGCCCCGTGGCCATGGAGTTGGCGGTCGA
GTGTTCCTTCCCCGTGGGGGAGGGGGCTGCCACAGGCATGATCTTTGTGCTGGGGCAGGCCG
AGGGAATACTCATCATGCTGGCAATGACGGCACTGACTGTGCGACGCTCGGAGCCGTCCTTG
TCCACCTGCCAGCAGGGGGAGGATCCACTTGACTGGACAGTGTCTCTGCTGCTGATGGCCGG
CCTGTGCACCTTCTTCAGCTGCATCCTGGCGGTCTTCTTCCACACCCCATACCGGCGCCTGC
AGGCCGAGTCTGGGGAGCCCCCCTCCACCCGTAACGCCGTGGGCGGCGCAGACTCAGGGCCG
GGTGTGGACCGAGGGGGAGCAGGAAGGGCTGGGGTCCTGGGGCCCAGCACGGCGACTCCGGA
GTGCACGGCGAGGGGGCCTCGCTAGAGGACCCCAGAGGGCCCGGGAGCCCCCACCCAGCCT
GCCACCGAGCGACTCCCCGTGCGCAAGGCCCAGCAGCCACCGACGCGCCCTCCCGCCCCGGC
AGACTCGCAGGCAGGGTCCAAGCGTCCAGGTTTATTGACCCGGCTGGGTCTCACTCCTCCTT
CTCCTCCCCGTGGGTGATCACGTAGCTGAGCGCCTTGTAGTCCAGGTTGCCCGCCACATCGA
TGGAGGCGAACTGGAACATCTGGTCCACCTGCGGGCGGGGCGAAAGGGCTCCTTGCGGGCT
CCGGGAGCGAATTACAAGCGCGCACCTGAAAA

FIGURE 169

```
></usr/seqdb2/sst/DNA/Dnaseqs.min/ss.DNA50988
><subunit 1 of 1, 560 aa, 1 stop
><MW: 58427, pI: 6.86, NX(S/T): 2
MAGPTEAETGLAEPRALCAQRGHRTYARRWVFLLAISLLNCSNATLWLSFAPVADVIAEDLV
LSMEQINWLSLVYLVVSTPFGVAAIWILDSVGLRAATILGAWLNFAGSVLRMVPCMVVGTQN
PFAFLMGGQSLCALAQSLVIFSPAKLAALWFPEHQRATANMLATMSNPLGVLVANVLSPVLV
KKGEDIPLMLGVYTIPAGVVCLLSTICLWESVPPTPPSAGAASSTSEKFLDGLKLQLMWNKA
YVILAVCLGGMIGISASFSALLEQILCASGHSSGFSGLCGALFITFGILGALALGPYVDRTK
HFTEATKIGLCLFSLACVPFALVSQLQGQTLALAATCSLLGLFGFSVGPVAMELAVECSFPV
GEGAATGMIFVLGQAEGILIMLAMTALTVRRSEPSLSTCQQGEDPLDWTVSLLLMAGLCTFF
SCILAVFFHTPYRRLQAESGEPPSTRNAVGGADSGPGVDRGGAGRAGVLGPSTATPECTARG
ASLEDPRGPGSPHPACHRATPRAQGPAATDAPSRPGRLAGRVQASRFIDPAGSHSSFSSPWVIT
```

Important features:

Signal peptide:

amino acids 1-44

Transmembrane domains:

amino acids 61-79, 98-112, 126-146, 169-182, 201-215, 248-268, 280-300, 318-337, 341-357, 375-387, 420-441

N-glycosylation site.

amino acids 40-43 and 43-46

Glycosaminoglycan attachment site.

amino acids 468-471

FIGURE 170

```
GTCCCACATCCTGCTCAACTGGGTCAGGTCCCTCTTAGACCAGCTCTTGTCCATCATTTGCTGAAGTGGACCAAC
TAGTTCCCCAGTAGGGGGTCTCCCCTGGCAATTCTTGATCGGCGTTTGGACATCTCAGATCGCTTCCAATGAAGA
TGGCCTTGCCTTGGGGTCCTGCTTGTTTCATAATCATCTAACTATGGGACAAGGTTGTGCCGGCAGCTCTGGGGG
AAGGAGCACGGGGCTGATCAAGCCATCCAGGAAACACTGGAGGACTTGTCCAGCCTTGAAAGAACTCTAGTGGTT
TCTGAATCTAGCCCACTTGGCGGTAAGCATGATGCAACTTCTGCAACTTCTGCTGGGGCTTTTGGGGCCAGGTGG
CTACTTATTTCTTTTAGGGGATTGTCAGGAGGTGACCACTCTCACGGTGAAATACCAAGTGTCAGAGGAAGTGCC
ATCTGGTACAGTGATCGGGAAGCTGTCCCAGGAACTGGGCCGGGAGGAGAGGCGGAGGCAAGCTGGGGCCGCCTT
CCAGGTGTTGCAGCTGCCTCAGGCGCTCCCCATTCAGGTGGACTCTGAGGAAGGCTTGCTCAGCACAGGCAGGCG
GCTGGATCGAGAGCAGCTGTGCCGACAGTGGGATCCCTGCCTGGTTTCCTTTGATGTGCTTGCCACAGGGGATTT
GGCTCTGATCCATGTGGAGATCCAAGTGCTGGACATCAATGACCACCAGCCACGGTTTCCCAAAGGCGAGCAGGA
GCTGGAAATCTCTGAGAGCGCCTCTCTGCGAACCCGGATCCCCCTGGACAGAGCTCTTGACCCAGACACAGGCCC
TAACACCCTGCACACCTACACTCTGTCTCCCAGTGAGCACTTTGCCTTGGATGTCATTGTGGGCCCTGATGAGAC
CAAACATGCAGAACTCATAGTGGTGAAGGAGCTGGACAGGGAAATCATTCATTTTTTGATCTGGTGTTAACTGC
CTATGACAATGGGAACCCCCCAAGTCAGGTACCAGCTTGGTCAAGGTCAACGTCTTGGACTCCAATGACAATAG
CCCTGCGTTTGCTGAGAGTTCACTGGCACTGGAAATCCAAGAAGATGCTGCACCTGGTACGCTTCTCATAAAACT
GACCGCCACAGACCCTGACCAAGGCCCCAATGGGGAGGTGGAGTTCTTCCTCAGTAAGCACATGCCTCCAGAGGT
GCTGGACACCTTCAGTATTGATGCCAAGACAGGCCAGGTCATTCTGCGTCGACCTCTAGACTATGAAAAGAACCC
TGCCTACGAGGTGGATGTTCAGGCAAGGGACCTGGGTCCCAATCCTATCCCAGCCCATTGCAAAGTTCTCATCAA
GGTTCTGGATGTCAATGACAACATCCCAAGCATCCACGTCACATGGGCCTCCCAGCCATCACTGGTGTCAGAAGC
TCTTCCCAAGGACAGTTTTATTGCTCTTGTCATGGCAGATGACTTGGATTCAGGACACAATGGTTTGGTCCACTG
CTGGCTGACCAAGACTGGGCCACTTCAGGCTGAAAAGAACTAATGGCAACACATACATGTTGCTAACCAATGC
CACACTGGACAGAGAGCAGTGGCCCAAATATACCCTCACTCTGTTAGCCCAAGACCAAGGACTCCAGCCCTTATC
AGCCAAGAAACAGCTCAGCATTCAGATCAGTGACATCAACGACAATGCACCTGTGTTTGAGAAAAGCAGGTATGA
AGTCTCCACGCGGGAAAACAACTTACCCTCTCTTCACCTCATTACCATCAAGGCTCATGATGCAGACTTGGGCAT
TAATGGAAAAGTCTCATACCGCATCCAGGACTCCCCAGTTGCTCACTTAGTAGCTATTGACTCCAACACAGGAGA
GGTCACTGCTCAGAGGTCACTGAACTATGAAGAGATGGCCGGCTTTGAGTTCCAGGTGATCGCAGAGGACAGCGG
GCAACCCATGCTTGCATCCAGTGTCTCTGTGTGGGTCAGCCTCTTGGATGCCAATGATAATGCCCCAGAGGTGGT
CCAGCCTGTGCTCAGCGATGGAAAAGCCAGCCTCTCCGTGCTTGTGAATGCCTCCACAGGCCACCTGCTGGTGCC
CATCGAGACTCCCAATGGCTTGGGCCCAGCGGGCACTGACACACCTCCACTGGCCACTCACAGCTCCCGGCCATT
CCTTTTGACAACCATTGTGGCAAGAGATGCAGACTCGGGGGCAAATGGAGAGCCCCTCTACAGCATCCGCAATGG
AAATGAAGCCCACCTCTTCATCCTCAACCCTCATACGGGGCAGCTGTTCGTCAATGTCACCAATGCCAGCAGCCT
CATTGGGAGTGAGTGGGAGCTGGAGATAGTAGTAGAGGACCAGGGAAGCCCCCCCTTACAGACCCGAGCCCTGTT
GAGGGTCATGTTTGTCACCAGTGTGGACCACCTGAGGGACTCAGCCCGCAAGCCTGGGGCCTTGAGCATGTCGAT
GCTGACGGTGATCTGCCTGGCTGTACTGTTGGGCATCTTCGGGTTGATCCTGGCTTTGTTCATGTCCATCTGCCG
GACAGAAAAGAAGGACAACAGGGCCTACAACTGTCGGGAGGCCGAGTCCACCTACCGCCAGCAGCCCAAGAGGCC
CCAGAAACACATTCAGAAGGCAGACATCCACCTCCGTGCCTGTGCTGAGCAGGGGTCAGGCAGGTGAGCCTTGTGAAGT
CGGGCAGTCCCACAAAGATGTGGACAAGGAGGCGATGATGGAAGCAGGCTGGGACCCCTGCCTGCAGGCCCCTT
CCACCTCACCCCGACCCTGTACAGGACGCTGCGTAATCAAGGCAACCAGGGAGCACCGGCGGAGAGCCGAGAGGT
GCTGCAAGACACGGTCAACCTCCTTTTCAACCATCCCAGGCAGAGGAATGCCTCCCGGGAGAACCTGAACCTTCC
CGAGCCCCAGCCTGCCACAGGCCAGCCACGTTCCAGGCCTCTGAAGGTTGCAGGCAGCCCCACAGGGAGGCTGGC
TGGAGACCAGGGCAGTGAGGAAGCCCCACAGAGGCCACCAGCCTCCTCTGCAACCCTGAGACGGCAGCGACATCT
CAATGGCAAAGTGTCCCCTGAGAAAGAATCAGGGCCCCGTCAGATCCTGCGGAGCCTGGTCCGGCTGTCTGTGGC
TGCCTTCGCCGAGCGGAACCCCGTGGAGGAGCTCACTGTGGATTCTCCTCCTGTTCAGCAAATCTCCCAGCTGCT
GTCCTTGCTGCATCAGGGCCAATTCCAGCCCAAACCAAACCACCGAGGAAATAAGTACTTGGCCAAGCCAGGAGG
CAGCAGGAGTGCAATCCCAGACACAGATGGCCCAAGTGCAAGGGCTGGAGGCCAGACAGACCCAGAACAGGAGGA
AGGGCCTTTGGATCCTGAAGAGGACCTCTCTGTGAAGCAACTGCTAGAAGAAGAGCTGTCAAGTCTGCTGGACCC
CAGCACAGGTCTGGCCCTGGACCGGCTGAGCGCCCCTGACCCGGCCTGGATGGCGAGACTCTCTTTGCCCCTCAC
CACCAACTACCGTGACAATGTGATCTCCCCGGATGCTGCAGCCACGGAGGAGCCGAGGACCTTCCAGACGTTCGG
CAAGGCAGAGGCACCAGAGCTGAGCCCAACAGGCACGAGGCTGGCCAGCACCTTTGTCTCGGAGATGAGCTCACT
GCTGGAGATGCTGCTGGAACAGCGCTCCAGCATGCCCGTGGAGGCCGCCTCCGAGGCGCTGCGGCGGCTCTCGGT
CTGCGGGAGGACCCTCAGTTTAGACTTGGCCACCAGTGCAGCCTCAGGCATGAAAGTGCAAGGGACCCAGGTGG
AAAGACGGGACTGAGGGCAAGAGCAGAGGCAGCAGCAGCAGCAGCAGGTGCCTTGAACATACCTCAGACGCCT
CTGGATCCAAGAACCAGGGGCCTGAGGATCTGTGGACAAGAGCTGGTTTCTAAAATCTTGTAACTCACTAGCTAG
CGGCGGCCTGAGAACTTTAGGGTGACTGATGCTACCCCCACAGAGGAGGCAAGAGCCCCAGGACTAACAGCTGAC
TGACCAAAGCAGCCCCTTGTAAGCAGCTCTGAGTCTTTTGGAGGACAGGGACGGTTTGGCTGAGATAAGTGTT
TCCTGGCAAAACATATGTGGAGCACAAAGGGTCAGTCCTCTGGCAGAACAGATGCCACGGAGTATCACAGGCAGG
AAAGGGTGGCCTTCTTGGGTAGCAGGAGTCAGGGGGCTGTACCCTGGGGGTGCCAGGAAATGCTCTCTGACCTAT
CAATAAAGGAAAAGCAGTAAAAAAAAAAAAAAAAAAAAA
```

FIGURE 171

```
</usr/seqdb2/sst/DNA/Dnaseqs.min/ss.DNA48331
<subunit 1 of 1, 1184 aa, 1 stop
<MW: 129022, pI: 5.20, NX(S/T): 5
MMQLLQLLLGLLGPGGYLFLLGDCQEVTTLTVKYQVSEEVPSGTVIGKLSQELGREERRRQA
GAAFQVLQLPQALPIQVDSEEGLLSTGRRLDREQLCRQWDPCLVSFDVLATGDLALIHVEIQ
VLDINDHQPRFPKGEQELEISESASLRTRIPLDRALDPDTGPNTLHTYTLSPSEHFALDVIV
GPDETKHAELIVVKELDREIHSFFDLVLTAYDNGNPPKSGTSLVKVNVLDSNDNSPAFAESS
LALEIQEDAAPGTLLIKLTATDPDQGPNGEVEFFLSKHMPPEVLDTFSIDAKTGQVILRRPL
DYEKNPAYEVDVQARDLGPNPIPAHCKVLIKVLDVNDNIPSIHVTWASQPSLVSEALPKDSF
IALVMADDLDSGHNGLVHCWLSQELGHFRLKRTNGNTYMLLTNATLDREQWPKYTLTLLAQD
QGLQPLSAKKQLSIQISDINDNAPVFEKSRYEVSTRENNLPSLHLITIKAHDADLGINGKVS
YRIQDSPVAHLVAIDSNTGEVTAQRSLNYEEMAGFEFQVIAEDSGQPMLASSVSVWVSLLDA
NDNAPEVVQPVLSDGKASLSVLVNASTGHLLVPIETPNGLGPAGTDTPPLATHSSRPFLLTT
IVARDADSGANGEPLYSIRNGNEAHLFILNPHTGQLFVNVTNASSLIGSEWELEIVVEDQGS
PPLQTRALLRVMFVTSVDHLRDSARKPGALSMSMLTVICLAVLLGIFGLILALFMSICRTEK
KDNRAYNCREAESTYRQQPKRPQKHIQKADIHLVPVLRGQAGEPCEVGQSHKDVDKEAMMEA
GWDPCLQAPFHLTPTLYRTLRNQGNQGAPAESREVLQDTVNLLFNHPRQRNASRENLNLPEP
QPATGQPRSRPLKVAGSPTGRLAGDQGSEEAPQRPPASSATLRRQRHLNGKVSPEKESGPRQ
ILRSLVRLSVAAFAERNPVEELTVDSPPVQQISQLLSLLHQGQFQPKPNHRGNKYLAKPGGS
RSAIPDTDGPSARAGGQTDPEQEEGPLDPEEDLSVKQLLEEELSSLLDPSTGLALDRLSAPD
PAWMARLSLPLTTNYRDNVISPDAAATEEPRTFQTFGKAEAPELSPTGTRLASTFVSEMSSL
LEMLLEQRSSMPVEAASEALRRLSVCGRTLSLDLATSAASGMKVQGDPGGKTGTEGKSRGSS
SSSRCL Important features:
Signal peptide:
amino acids 1-13
Transmembrane domain:
amino acids 719-739
N-glycosylation site.
amino acids 415-418, 582-585, 659-662, 662-665 amd 857-860
Cadherins extracellular repeated domain signature.
amino acids 123-133, 232-242, 340-350, 448-458 and 553-563
```

FIGURE 172

CGGACGCGTGGGCGGACGCGTGGGGGAGAGCCGCAGTCCCGGCTGCAGCACCTGGGAGAAGG
CAGACCGTGTGAGGGGGCCTGTGGCCCCAGCGTGCTGTGGCCTCGGGGAGTGGGAAGTGGAG
GCAGGAGCCTTCCTTACACTTCGCCATGAGTTTCCTCATCGACTCCAGCATCATGATTACCT
CCCAGATACTATTTTTGGATTTGGGTGGCTTTTCTTCATGCGCCAATTGTTTAAAGACTAT
GAGATACGTCAGTATGTTGTACAGGTGATCTTCTCCGTGACGTTTGCATTTTCTTGCACCAT
GTTTGAGCTCATCATCTTTGAAATCTTAGGAGTATTGAATAGCAGCTCCCGTTATTTTCACT
GGAAAATGAACCTGTGTGTAATTCTGCTGATCCTGGTTTTCATGGTGCCTTTTTACATTGGC
TATTTTATTGTGAGCAATATCCGACTACTGCATAAACAACGACTGCTTTTTTCCTGTCTCTT
ATGGCTGACCTTTATGTATTTCTTCTGGAAACTAGGAGATCCCTTTCCCATTCTCAGCCCAA
AACATGGATCTTATCCATAGAACAGCTCATCAGCCGGGTTGGTGTGATTGGAGTGACTCTC
ATGGCTCTTCTTTCTGGATTTGGTGCTGTCAACTGCCCATACACTTACATGTCTTACTTCCT
CAGGAATGTGACTGACACGGATATTCTAGCCCTGGAACGGCGACTGCTGCAAACCATGGATA
TGATCATAAGCAAAAGAAAAGGATGGCAATGGCACGGAGAACAATGTTCCAGAAGGGGGAA
GTGCATAACAAACCATCAGGTTTCTGGGGAATGATAAAAAGTGTTACCACTTCAGCATCAGG
AAGTGAAAATCTTACTCTTATTCAACAGGAAGTGGATGCTTTGGAAGAATTAAGCAGGCAGC
TTTTTCTGGAAACAGCTGATCTATATGCTACCAAGGAGAGAATAGAATACTCCAAAACCTTC
AAGGGGAAATATTTTAATTTTCTTGGTTACTTTTTCTCTATTTACTGTGTTTGGAAAATTTT
CATGGCTACCATCAATATTGTTTTTGATCGAGTTGGGAAAACGGATCCTGTCACAAGAGGCA
TTGAGATCACTGTGAATTATCTGGGAATCCAATTTGATGTGAAGTTTTGGTCCCAACACATT
TCCTTCATTCTTGTTGGAATAATCATCGTCACATCCATCAGAGGATTGCTGATCACTCTTAC
CAAGTTCTTTTATGCCATCTCTAGCAGTAAGTCCTCCAATGTCATTGTCCTGCTATTAGCAC
AGATAATGGGCATGTACTTTGTCTCCTCTGTGCTGCTGATCCGAATGAGTATGCCTTTAGAA
TACCGCACCATAATCACTGAAGTCCTTGGAGAACTGCAGTTCAACTTCTATCACCGTTGGTT
TGATGTGATCTTCCTGGTCAGCGCTCTCTCTAGCATACTCTTCCTCTATTTGGCTCACAAAC
AGGCACCAGAGAAGCAAATGGCACCTTGAACTTAAGCCTACTACAGACTGTTAGAGGCCAGT
GGTTTCAAAATTTAGATATAAGAGGGGGGAAAAATGGAACCAGGGCCTGACATTTTATAAAC
AAACAAAATGCTATGGTAGCATTTTTCACCTTCATAGCATACTCCTTCCCCGTCAGGTGATA
CTATGACCATGAGTAGCATCAGCCAGAACATGAGAGGGAGAACTAACTCAAGACAATACTCA
GCAGAGAGCATCCCGTGTGGATATGAGGCTGGTGTAGAGGCGGAGAGGAGCCAAGAAACTAA
AGGTGAAAAATACACTGGAACTCTGGGGCAAGACATGTCTATGGTAGCTGAGCCAAACACGT
AGGATTTCCGTTTTAAGGTTCACATGGAAAAGGTTATAGCTTTGCCTTGAGATTGACTCATT
AAAATCAGAGACTGTAACAAAAAAAAAAAAAAAAAAAAGGGCGGCCGCGACTCTAGAGTCG
ACCTGCAGAAGCTTGGCCGCCATGGCCCAACTTGTTTATTGCAGCTTATAATG

FIGURE 173

MSFLIDSSIMITSQILFFGFGWLFFMRQLFKDYEIRQYVVQVIFSVTFAFSCTMFELIIFEI
LGVLNSSSRYFHWKMNLCVILLILVFMVPFYIGYFIVSNIRLLHKQRLLFSCLLWLTFMYFF
WKLGDPFPILSPKHGILSIEQLISRVGVIGVTLMALLSGFGAVNCPYTYMSYFLRNVTDTDI
LALERRLLQTMDMIISKKKRMAMARRTMFQKGEVHNKPSGFWGMIKSVTTSASGSENLTLIQ
QEVDALEELSRQLFLETADLYATKERIEYSKTFKGKYFNFLGYFFSIYCVWKIFMATINIVF
DRVGKTDPVTRGIEITVNYLGIQFDVKFWSQHISFILVGIIIVTSIRGLLITLTKFFYAISS
SKSSNVIVLLLAQIMGMYFVSSVLLIRMSMPLEYRTIITEVLGELQFNFYHRWFDVIFLVSA
LSSILFLYLAHKQAPEKQMAP

Important features:

Signal peptide:

amino acids 1-23

Potential transmembrane domains:

amino acids 37-55, 81-102, 150-168, 288-311, 338-356, 375-398, 425-444

N-glycosylation sites.

amino acids 67-70, 180-183 and 243-246

Eukaryotic cobalamin-binding proteins amino acids 151-160

FIGURE 174

CATGGGAAGTGGAGCCGGAGCCTTCCTTACACTCGCCATGAGTTTCCTCATCGACTCCAGCA
TCATGATTACCTCCCNGANACTATTTTTTGGATTTGGGTGGCTTTTCTTCNGCGCCAATGTT
TAAAGACTATGAGATACGTCAGTATGTTGTACNGGTGATCTTCTCCGTGACGTTTGCCATTT
CTTGCACCATGTTTGAGCTCATCATCTTTGAAATCTTNGGAGTATTGAATAGCAGCTCCCGT
TATTTTCACTGGAAAATGAACCTGTGTGTAATTCTGCTGATCCTGGTTNTCATGGTGCCTTT
TTACATTGGCTATTTTATTGTGAGCAATATCCGACTACTGCATAAACAACGACTGCTTTTTT
CCTGTCTCTTATGGCTGACCTTTATGTATTTCCAG

FIGURE 175

GTGTTGCCCTTGGGGAGGGGAAGGGGAGCCNGGCCCTTTCCTAAAATTTGGCCAAGGGTTTC
TTTNTTGAATTCCGGGTTNNGNATACCTTCCCAGAAAATATTTTTTGGATTTGGGGTAGNTT
TTTTTCATGCGCCAATTGTTTAAAGACTATGAGATACGTCAGTATGTTGTACAGGTGATNTT
NTCCGTGACGTTTGCATTTTCTTGCACCATGTTTGAGCTCATCATNTTTGAAATNTTAGGAG
TATTGAATAGCAGCTCCCGTTATTTTCACTGGAAAATGAACCTGTGTGTAATTCTGCTGATC
CTGGTTTTCATGGTGCCTTTTTACATTGGCTATTTTATTGTGAGCAATATCCGACTACTGCA
TAAACAACGACTGCTTTTTTCCTGTCTNTTATGGCTGACCTTTATGTATTTNTTNTGGAAAN
TAGGAGATCCCTTTCCCATTCTC

FIGURE 176

```
CTCGCGCAGGGATCGTCCCATGGCCGGGGCTCGGAGCCGCGACCCTTGGGGGGCCTCCGGGATTTGCTACCTTTT
TGGCTCCCTGCTCGTCGAACTGCTCTTCTCACGGGCTGTCGCCTTCAATCTGGACGTGATGGGTGCCTTGCGCAA
GGAGGGCGAGCCAGGCAGCCTCTTCGGCTTCTCTGTGGCCCTGCACCGGCAGTTGCAGCCCCGACCCCAGAGCTG
GCTGCTGGTGGGTGCTCCCCAGGCCCTGGCTCTTCCTGGGCAGCAGGCGAATCGCACTGGAGGCCTCTTCGCTTG
CCCGTTGAGCCTGGAGGAGACTGACTGCTACAGAGTGGACATCGACCAGGGAGCTGATATGCAAAAGGAAAGCAA
GGAGAACCAGTGGTTGGGAGTCAGTGTTCGGAGCCAGGGGCCTGGGGCAAGATTGTTACCTGTGCACACCGATA
TGAGGCAAGGCAGCGAGTGGACCAGATCCTGGAGACGCGGGATATGATTGGTCGCTGCTTTGTGCTCAGCCAGGA
CCTGGCCATCCGGGATGAGTTGGATGGTGGGGAATGGAAGTTCTGTGAGGGACGCCCCCAAGGCCATGAACAATT
TGGGTTCTGCCAGCAGGGCACAGCTGCCGCCTTCTCCCCTGATAGCCACTACCTCCTCTTTGGGGCCCCAGGAAC
CTATAATTGGAAGGGCACGGCCAGGGTGGAGCTCTGTGCACAGGGCTCAGCGGACCTGGCACACCTGGACGACGG
TCCCTACGAGGCGGGGGGAGAGAAGGAGCAGGACCCCCGCCTCATCCCGGTCCCTGCCAACAGCTACTTTGGCTT
CTCTATTGACTCGGGGAAAGGTCTGGTGCGTGCAGAAGAGCTGAGCTTTGTGGCTGGAGCCCCCGCGCCAACCA
CAAGGGTGCTGTGGTCATCCTGCGCAAGGACAGCGCCAGTCGCCTGGTGCCCGAGGTTATGCTGTCTGGGGAGCG
CCTGACCTCCGGCTTTGGCTACTCACTGGCTGTGACCTCAACAGTGATGGCTGGCCAGACCTGATAGTGGG
TGCCCCCTACTTCTTTGAGCGCCAAGAAGAGCTGGGGGGTGCTGTGTATGTGTACTTGAACCAGGGGGGTCACTG
GGCTGGGATCTCCCCTCTCCGGCTCTGCGGCTCCCCTGACTCCATGTTCGGGATCAGCCTGGCTGTCCTGGGGGA
CCTCAACCAAGATGGCTTTCCAGATATTGCAGTGGGTGCCCCCTTTGATGGTGATGGGAAAGTCTTCATCTACCA
TGGGAGCAGCCTGGGGGTTGTCGCCAAACCTTCACAGGTGCTGGAGGGCGAGGCTGTGGGCATCAAGAGCTTCGG
CTACTCCCTGTCAGGCAGCTTGGATATGGATGGGAACCAATACCCTGACCTGCTGGTGGGCTCCCTGGCTGACAC
CGCAGTGCTCTTCAGGGCCAGACCCATCCTCCATGTCTCCCATGAGGTCTCTATTGCTCCACGAAGCATCGACCT
GGAGCAGCCCAACTGTGCTGGCGGCCACTCGGTCTGTGTGGACCTAAGGGTCTGTTTCAGCTACATTGCAGTCCC
CAGCAGCTATAGCCCTACTGTGGCCCTGGACTATGTGTTAGATGCGGACACAGACCGGAGGCTCCGGGGCCAGGT
TCCCCGTGTGACGTTCCTGAGCCGTAACCTGGAAGAACCCAAGCACCAGGCCTCGGGCACCGTGTGGCTGAAGCA
CCAGCATGACCGAGTCTGTGGAGACGCCATGTTCCAGCTCCAGGAAAATGTCAAAGACAAGCTTCGGGCCATTGT
AGTGACCTTGTCCTACAGTCTCCAGACCCCTCGGCTCCGGCGACAGGCTCCTGGCCAGGGGCTGCCTCCAGTGGC
CCCCATCCTCAATGCCCACCAGCCCAGCACCCAGCGGGCAGAGATCCACTTCCTGAAGCAAGGCTGTGGTGAAGA
CAAGATCTGCCAGAGCAATCTGCAGCTGGTCCACGCCCGCTTCTGTACCCGGGTCAGCGACACGGAATTCCAACC
TCTGCCCATGGATGTGGATGGAACAACAGCCCTGTTTGCACTGAGTGGGCAGCCAGTCATTGGCCTGGAGCTGAT
GGTCACCAACCTGCCATCGGACCCAGCCCAGCCCCAGGCTGATGGGGATGATGCCCATGAAGCCCAGCTCCTGGT
CATGCTTCCTGACTCACTGCACTACTCAGGGGTCCGGGCCCTGGACCCTGCGGAGAAGCCACTCTGCCTGTCCAA
TGAGAATGCCTCCCATGTTGAGTGTGAGCTGGGGAACCCCATGAAGAGAGGTGCCCAGGTCACCTTCTACCTCAT
CCTTAGCACCTCCGGGATCAGCATTGAGACCACGGAACTGGAGGTAGAGCTGCTGTTGGCCACGATCAGTGAGCA
GGAGCTGCATCCAGTCTCTGCACGAGCCCGTGTCTTCATTGAGCTGCCACTGTCCATTGCAGGAATGGCCATTCC
CCAGCAACTCTTCTTCTCTGGTGTGGTGAGGGGCGAGAGAGCCATGCAGTCTGAGCGGGATGTGGGCAGCAAGGT
CAAGTATGAGGTCACGGTTTCCAACCAAGGCCAGTCGCTCAGAACCCTGGGCTCTGCCTTCCTCAACATCATGTG
GCCTCATGAGATTGCCAATGGGAAGTGGTTGCTGTACCCAATGCAGGTTGAGCTGGAGGGCGGGCAGGGGCCTGG
GCAGAAAGGGCTTTGCTCTCCCAGGCCCAACATCCTCCACCTGGATGTGGACAGTAGGGATAGGAGGCGGCGGGA
GCTGGAGCCACCTGAGCAGCAGGAGCCTGGTGAGCGGCAGGAGCCCAGCATGTCCTGGTGGCCAGTGTCCTCTGC
TGAGAAGAAGAAAAACATCACCCTGGACTGCGCCGGGGCACGGCCAACTGTGTGGTGTTCAGCTGCCCACTCTA
CAGCTTTGACCGCGCGGCTGTGCTGCATGTCTGGGGCCGTCTCTGGAACAGCACCTTTCTGGAGGAGTACTCAGC
TGTGAAGTCCCTGGAAGTGATTGTCCGGGCCAACATCACAGTGAAGTCCTCCATAAAGAACTTGATGCTCCGAGA
TGCCTCCACAGTGATCCCAGTGATGGTATACTTGGACCCCATGGCTGTGGTGGCAGAAGGAGTGCCCTGGTGGGT
CATCCTCCTGGCTGTACTGGCTGGGCTGCTGGTGCTAGCACTGCTGGTGCTGCTCCTGTGGAAGATGGGATTCTT
CAAACGGGCGAAGCACCCCGAGGCCACCGTGCCCCAGTACCATGCGGTGAAGATTCCTCGGGAAGACCGACAGCA
GTTCAAGGAGGAGAAGACGGGCACCATCCTGAGGAACAACTGGGGCAGCCCCGGCGGGAGGCCCGGATGCACA
CCCCATCCTGGCTGCTGACGGGCATCCCGAGCTGGGCCCCGATGGGCATCCAGGGCCAGGCACCGCCTAGGTTCC
CATGTCCCAGCCTGGCCTGTGGCTGCCCTCCATCCCTTCCCCAGAGATGGCTCCTTGGGATGAAGAGGGTAGAGT
GGGCTGCTGGTGTCGCATCAAGATTTGGCAGGATCGGCTTCCTCAGGGGCACAGACCTCTCCCACCCACAAGAAC
TCCTCCCACCCAACTTCCCCTTAGAGTGCTGTGAGATGAGAGTGGGTAAATCAGGGACAGGGCCATGGGGTAGGG
TGAGAAGGGCAGGGGTGTCCTGATGCAAAGGTGGGGAGAAGGGATCCTAATCCCTTCCTCTCCCATTCACCCTGT
GTAACAGGACCCCAAGGACCTGCCTCCCCGGAAGTGCCTTAACCTAGAGGGTCGGGGAGGAGGTTGTGTCACTGA
CTCAGGCTGCTCCTTCTCTAGTTTCCCCTCTCATCTGACCTTAGTTTGCTGCCATCAGTCTAGTGGTTTCGTGGT
TTCGTCTATTTATTAAAAAATATTTGAGAACAAAAAAAAAAAAAAAAAAAA
```

FIGURE 177

></usr/seqdb2/sst/DNA/Dnaseqs.min/ss.DNA55737
><subunit 1 of 1, 1141 aa, 1 stop
><MW: 124671, pI: 5.82, NX(S/T): 5

MAGARSRDPWGASGICYLFGSLLVELLFSRAVAFNLDVMGALRKEGEPGSLFGFSVALHRQL
QPRPQSWLLVGAPQALALPGQQANRTGGLFACPLSLEETDCYRVDIDQGADMQKESKENQWL
GVSVRSQGPGGKIVTCAHRYEARQRVDQILETRDMIGRCFVLSQDLAIRDELDGGEWKFCEG
RPQGHEQFGFCQQGTAAAFSPDSHYLLFGAPGTYNWKGTARVELCAQGSADLAHLDDGPYEA
GGEKEQDPRLIPVPANSYFGFSIDSGKGLVRAEELSFVAGAPRANHKGAVVILRKDSASRLV
PEVMLSGERLTSGFGYSLAVADLNSDGWPDLIVGAPYFFERQEELGGAVYVYLNQGGHWAGI
SPLRLCGSPDSMFGISLAVLGDLNQDGFPDIAVGAPFDGDKVFIYHGSSLGVVAKPSQVLE
GEAVGIKSFGYSLSGSLDMDGNQYPDLLVGSLADTAVLFRARPILHVSHEVSIAPRSIDLEQ
PNCAGGHSVCVDLRVCFSYIAVPSSYSPTVALDYVLDADTDRRLRGQVPRVTFLSRNLEEPK
HQASGTVWLKHQHDRVCGDAMFQLQENVKDKLRAIVVTLSYSLQTPRLRRQAPGQGLPPVAP
ILNAHQPSTQRAEIHFLKQGCGEDKICQSNLQLVHARFCTRVSDTEFQPLPMDVDGTTALFA
LSGQPVIGLELMVTNLPSDPAQPQADGDDAHEAQLLVMLPDSLHYSGVRALDPAEKPLCLSN
ENASHVECELGNPMKRGAQVTFYLILSTSGISIETTELEVELLLATISEQELHPVSARARVF
IELPLSIAGMAIPQQLFFSGVVRGERAMQSERDVGSKVKYEVTVSNQGQSLRTLGSAFLNIM
WPHEIANGKWLLYPMQVELEGGQGPGQKGLCSPRPNILHLDVDSRDRRRRELEPPEQQEPGE
RQEPSMSWWPVSSAEKKKNITLDCARGTANCVVFSCPLYSFDRAAVLHVGRLWNSTFLEEY
SAVKSLEVIVRANITVKSSIKNLMLRDASTVIPVMVYLDPMAVVAEGVPWWVILLAVLAGLL
VLALLVLLLWKMGFFKRAKHPEATVPQYHAVKIPREDRQQFKEEKTGTILRNNWGSPRREGP
DAHPILAADGHPELGPDGHPGPGTA

Important features:

Signal peptide:

amino acids 1-33

Transmembrane domain:

amino acids 1040-1062

N-glycosylation sites.

amino acids 86-89, 746-749, 949-952, 985-988 and 1005-1008

Integrins alpha chain proteins.

amino acids 1064-1071, 384-408, 1041-1071, 317-346, 443-465, 385-407, 215-224, 634-647, 85-99, 322-346, 470-479, 442-466, 379-408 and 1031-1047

FIGURE 178

CGCGCCGGGCGCAGGGAGCTGAGTGGACGGCTCGAGACGGCGGCGCGTGCAGCAGCTCCAGA
AAGCAGCGAGTTGGCAGAGCAGGGCTGCATTTCCAGCAGGAGCTGCGAGCACAGTGCTGGCT
CACAACAAGATGCTCAAGGTGTCAGCCGTACTGTGTGTGTGCAGCCGCTTGGTGCAGTCA
GTCTCTCGCAGCTGCCGCGGCGGTGGCTGCAGCCGGGGGCGGTCGGACGGCGGTAATTTTC
TGGATGATAAACAATGGCTCACCACAATCTCTCAGTATGACAAGGAAGTCGGACAGTGGAAC
AAATTCCGAGACGAAGTAGAGGATGATTATTTCCGCACTTGGAGTCCAGGAAAACCCTTCGA
TCAGGCTTTAGATCCAGCTAAGGATCCATGCTTAAAGATGAAATGTAGTCGCCATAAAGTAT
GCATTGCTCAAGATTCTCAGACTGCAGTCTGCATTAGTCACCGGAGGCTTACACACAGGATG
AAAGAAGCAGGAGTAGACCATAGGCAGTGGAGGGGTCCCATATTATCCACCTGCAAGCAGTG
CCCAGTGGTCTATCCCAGCCCTGTTTGTGGTTCAGATGGTCATACCTACTCTTTTCAGTGCA
AACTAGAATATCAGGCATGTGTCTTAGGAAAACAGATCTCAGTCAAATGTGAAGGACATTGC
CCATGTCCTTCAGATAAGCCCACCAGTACAAGCAGAAATGTTAAGAGAGCATGCAGTGACCT
GGAGTTCAGGGAAGTGGCAAACAGATTGCGGGACTGGTTCAAGGCCCTTCATGAAAGTGGAA
GTCAAAACAAGAAGACAAAAACATTGCTGAGGCCTGAGAGAAGCAGATTCGATACCAGCATC
TTGCCAATTTGCAAGGACTCACTTGGCTGGATGTTTAACAGACTTGATACAAACTATGACCT
GCTATTGGACCAGTCAGAGCTCAGAAGCATTTACCTTGATAAGAATGAACAGTGTACCAAGG
CATTCTTCAATTCTTGTGACACATACAAGGACAGTTTAATATCTAATAATGAGTGGTGCTAC
TGCTTCCAGAGACAGCAAGACCCACCTTGCCAGACTGAGCTCAGCAATATTCAGAAGCGGCA
AGGGGTAAAGAAGCTCCTAGGACAGTATATCCCCCTGTGTGATGAAGATGGTTACTACAAGC
CAACACAATGTCATGGCAGTGTTGGACAGTGCTGGTGTGTTGACAGATATGGAAATGAAGTC
ATGGGATCCAGAATAAATGGTGTTGCAGATTGTGCTATAGATTTTGAGATCTCCGGAGATTT
TGCTAGTGGCGATTTTCATGAATGGACTGATGATGAGGATGATGAAGACGATATTATGAATG
ATGAAGATGAAATTGAAGATGATGATGAAGATGAAGGGGATGATGATGATGGTGGTGATGAC
CATGATGTATACATTTGATTGATGACAGTTGAAATCAATAAATTCTACATTTCTAATATTTA
CAAAATGATAGCCTATTTAAAATTATCTTCTTCCCCAATAACAAAATGATTCTAAACCTCA
CATATATTTTGTATAATTATTTGAAAAATTGCAGCTAAAGTTATAGAACTTTATGTTTAAAT
AAGAATCATTTGCTTTGAGTTTTTATATTCCTTACACAAAAAGAAAATACATATGCAGTCTA
GTCAGACAAAATAAAGTTTTGAAGTGCTACTATAATAAATTTTTCACGAGAACAAACTTTGT
AAATCTTCCATAAGCAAATGACAGCTAGTGCTTGGGATCGTACATGTTAATTTTTTGAAAG
ATAATTCTAAGTGAAATTTAAAATAAATAAATTTTTAATGACCTGGGTCTTAAGGATTTAGG
AAAAATATGCATGCTTTAATTGCATTTCCAAAGTAGCATCTTGCTAGACCTAGATGAGTCAG
GATAACAGAGAGATACCACATGACTCCAAAAAAAAAAAAAAA

FIGURE 179

></usr/seqdb2/sst/DNA/Dnaseqs.min/ss.DNA49829
><subunit 1 of 1, 436 aa, 1 stop
><MW: 49429, pI: 4.80, NX(S/T): 0

MLKVSAVLCVCAAAWCSQSLAAAAAVAAAGGRSDGGNFLDDKQWLTTISQYDKEVGQWNKFR
DEVEDDYFRTWSPGKPFDQALDPAKDPCLKMKCSRHKVCIAQDSQTAVCISHRRLTHRMKEA
GVDHRQWRGPILSTCKQCPVVYPSPVCGSDGHTYSFQCKLEYQACVLGKQISVKCEGHCPCP
SDKPTSTSRNVKRACSDLEFREVANRLRDWFKALHESGSQNKKTKTLLRPERSRFDTSILPI
CKDSLGWMFNRLDTNYDLLLDQSELRSIYLDKNEQCTKAFFNSCDTYKDSLISNNEWCYCFQ
RQQDPPCQTELSNIQKRQGVKKLLGQYIPLCDEDGYYKPTQCHGSVGQCWCVDRYGNEVMGS
RINGVADCAIDFEISGDFASGDFHEWTDDEDDEDDIMNDEDEIEDDDEDEGDDDDGGDDHDVYI

Important features:

Signal peptide:

amino acids 1-16

Leucine zipper pattern.

amino acids 246-267

N-myristoylation sites.

amino acids 357-362, 371-376 and 376-381

Thyroglobulin type-1 repeat proteins amino acids 353-365 and 339-352

FIGURE 180

```
CAGACTCCAGATTTCCCTGTCAACCACGAGGAGTCCAGAGAGGAAACGCGGAGCGGAGACAACAGTACCTGACGC
CTCTTTCAGCCCGGGATCGCCCCAGCAGGGATGGGCGACAAGATCTGGCTGCCCTTCCCCGTGCTCCTTCTGGCC
GCTCTGCCTCCGGTGCTGCTGCCTGGGGCGGCCGGCTTCACACCTTCCCTCGATAGCGACTTCACCTTTACCCTT
CCCGCCGGCCAGAAGGAGTGCTTCTACCAGCCCATGCCCCTGAAGGCCTCGCTGGAGATCGAGTACCAAGTTTTA
GATGGAGCAGGATTAGATATTGATTTCCATCTTGCCTCTCCAGAAGGCAAAACCTTAGTTTTTGAACAAAGAAAA
TCAGATGGAGTTCACACTGTAGAGACTGAAGTTGGTGATTACATGTTCTGCTTTGACAATACATTCAGCACCATT
TCTGAGAAGGTGATTTTCTTTGAATTAATCCTGGATAATATGGGAGAACAGGCACAAGAACAAGAAGATTGGAAG
AAATATATTACTGGCACAGATATATTGGATATGAAACTGGAAGACATCCTGGAATCCATCAACAGCATCAAGTCC
AGACTAAGCAAAAGTGGGCACATACAAATTCTGCTTAGAGCATTTGAAGCTCGTGATCGAAACATACAAGAAAGC
AACTTTGATAGAGTCAATTTCTGGTCTATGGTTAATTTAGTGGTCATGGTGGTGGTGTCAGCCATTCAAGTTTAT
ATGCTGAAGAGTCTGTTTGAAGATAAGAGGAAAAGTAGAACTTAAAACTCCAAACTAGAGTACGTAACATTGAAA
AATGAGGCATAAAAATGCAATAAACTGTTACAGTCAAGACCATTAATGGTCTTCTCCAAAATATTTTGAGATATA
AAAGTAGGAAACAGGTATAATTTTAATGTGAAAATTAAGTCTTCACTTTCTGTGCAAGTAATCCTGCTGATCCAG
TTGTACTTAAGTGTGTAACAGGAATATTTTGCAGAATATAGGTTTAACTGAATGAAGCCATATTAATAACTGCAT
TTTCCTAACTTTGAAAAATTTTGCAAATGTCTTAGGTGATTTAAATAAATGAGTATTGGGCCTAATTGCAACACC
AGTCTGTTTTTAACAGGTTCTATTACCCAGAACTTTTTTGTAAATGCGGCAGTTACAAATTAACTGTGGAAGTTT
TCAGTTTTAAGTTATAAATCACCTGAGAATTACCTAATGATGGATTGAATAAATCTTTAGACTACAAAAGCCCAA
CTTTTCTCTATTTACATATGCATCTCTCCTATAATGTAAATAGAATAATAGCTTTGAAATACAATTAGGTTTTTG
AGATTTTTATAACCAAATACATTTCAGTGTAACATATTAGCAGAAAGCATTAGTCTTTGTACTTTGCTTACATTC
CCAAAAGCTGACATTTTCACGATTCTTAAAAACACAAAGTTACACTTACTAAAATTAGGACATGTTTTCTCTTTG
AAATGAAGAATATAGTTTAAAAGCTTCCTCCTCCATAGGGACACATTTTCTCTAACCCTTAACTAAAGTGTAGGA
TTTTAAAATTAAATGTGAGGTAAAATAAGTTTATTTTTAATAGTATCTGTCAAGTTAATATCTGTCAACAGTTAA
TAATCATGTTATGTTAATTTTAACATGATTGCTGACTTGGATAATTCATTATTACCAGCAGTTATGAAGGAAATA
TTGCTAAAATGATCTGGGCCTACCATAAATAAATATCTCCTTTTCTGAGCTCTAAGAATTATCAGAAAACAGGAA
AGAATTTAGAAAAACTTGAGAAAACCTAATCCAAAATAAAATTCACTTAAGTAGAACTATAAATAAATATCTAGA
ATCTGACTGGCTCATCATGACATCCTACTCATAACATAAATCAAAGGAGATGATTAATTTCCAGTTAGCTGGAAG
AAACTTTGGCTGTAGGTTTTTATTTTCTACAAGAATTCTGGTTTGAATTATTTTGTAAGCAGGTACATTTTATA
AAATGTAAGCCCTACTGTAAGGTTTAGCACTGGGTGTACATATTTATTAAAAATTTTTATTATAACAACTTTTAT
TAAAATGGCCTTTCTGAACACTTTATTTATTGATGTTGAAGTAAGGATTAGAAACATAGACTCCCAAGTTTTAAA
CACCTAAATGTGAATAACCCATATATACAACAAAGTTTCTGCCATCTAGCTTTTTGAAGTCTATGGGGGTCTTAC
TCAAGTACTAGTAATTTAACTTCATCATGAATGAACTATAATTTTTAAGTTATGCCCATTTATAACGTTGTTTAT
GACTACATTGTGAGTTAGAAACAAACTTAAAATTTGGGGTATAGAACCCCTCAACAGGTTAGTAATGCTGGAATT
CTTGATGAGCAATAATGATAACCAGAGAGTGATTTCATTTACACTCATAGTAGTATAAAAGAGATACATTTCCC
TCTTAGGCCCCTGGGAGAAGAGCAGCTTAGATTTCCCTACTGGCAAGGTTTTTAAAAATGAGGTAAATGCCGTAT
ATGATCAATTACCTTAATTGGCCAAGAAAATGCTTCAGGTGTCTAGGGGTATCCTCTGCAACACTTGCAGAACAA
AGGTCAATAAGATCCTTGCCTATGAATACCCCTCCCTTTTGCGCTGTTAAATTTGCAATGAGAAGCAAATTTACA
GTACCATAACTAATAAAGCAGGGTACAGATATAAACTACTGCATCTTTTCTATAAAACTGTGATTAAGAATTCTA
CCTCTCCTGTATGGCTGTTACTGTACTGTACTCTCTGACTCCTTACCTAACAATGAATTTGTTACATAATCTTCT
ACATGTATGATTTGTGCCACTGATCTTAAACCTATGATTCAGTAACTTCTTACCATATAAAAACGATAATTGCTT
TATTTGGAAAAGAATTTAGGAATACTAAGGACAATTATTTTTATAGACAAAGTAAAAAGACAGATATTTAAGAGG
CATAACCAAAAAAGCAAAACTTGTAAACAGAGTAAAAATCTTTAATATTTCTAAAGACATACTGTTTATCTGCTT
CATATGCTTTTTTTAATTTCACTATTCCATTTCTAAATTAAAGTTATGCTAAATTGAGTAAGCTGTTTATCACTT
AACAGCTCATTTTGTCTTTTTCAATATACAAATTTTAAAAATACTACAATATTTAACTAAGGCCCAACCGATTTC
CATAATGTAGCAGTTACCGTGTTCACCTCACACTAAGGCCTAGAGTTTGCTCTGATATGCATTTGGATGATTAAT
GTTATGCTGTTCTTTCATGTGAATGTCAAGACATGGAGGGTGTTTGTAATTTTATGGTAAAATTAATCCTTCTTA
CACATAATGGTGTCTTAAAATTGACAAAAAATGAGCACTTACAATTGTATGTCTCCTCAAATGAAGATTCTTTAT
GTGAAATTTTAAAAGACATTGATTCCGCATGTAAGGATTTTTCATCTGAAGTACAATAATGCACAATCAGTGTTG
CTCAAACTGCTTTATACTTATAAACAGCCATCTTAAATAAGCAACGTATTGTGAGTACTGATATGTATATAATAA
AAATTATCAAAGGAAAA
```

FIGURE 181

></usr/seqdb2/sst/DNA/Dnaseqs.min/ss.DNA52196
><subunit 1 of 1, 229 aa, 1 stop
><MW: 26017, pI: 4.73, NX(S/T): 0
MGDKIWLPFPVLLLAALPPVLLPGAAGFTPSLDSDFTFTLPAGQKECFYQPMPLKASLEIEY
QVLDGAGLDIDFHLASPEGKTLVFEQRKSDGVHTVETEVGDYMFCFDNTFSTISEKVIFFEL
ILDNMGEQAQEQEDWKKYITGTDILDMKLEDILESINSIKSRLSKSGHIQILLRAFEARDRN
IQESNFDRVNFWSMVNLVVMVVVSAIQVYMLKSLFEDKRKSRT Important features:
Signal peptide:
amino acids 1-23

Transmembrane domain:
amino acids 195-217

N-myristoylation site.
amino acids 43-48

Tyrosine kinase phosphorylation site.
amino acids 55-62

FIGURE 182

CCATCCCTGAGATCTTTTTATAAAAAACCCAGTCTTTGCTGACCAGACAAAGCATACCAGAT
CTCACCAGAGAGTCGCAGACACTATGCTGCCTCCCATGGCCCTGCCCAGTGTGTCCTGGATG
CTGCTTTCCTGCCTCATTCTCCTGTGTCAGGTTCAAGGTGAAGAAACCCAGAAGGAACTGCC
CTCTCCACGGATCAGCTGTCCCAAAGGCTCCAAGGCCTATGGCTCCCCTGCTATGCCTTGT
TTTTGTCACCAAAATCCTGGATGGATGCAGATCTGGCTTGCCAGAAGCGGCCCTCTGGAAAA
CTGGTGTCTGTGCTCAGTGGGGCTGAGGGATCCTTCGTGTCCTCCCTGGTGAGGAGCATTAG
TAACAGCTACTCATACATCTGGATTGGGCTCCATGACCCCACACAGGGCTCTGAGCCTGATG
GAGATGGATGGGAGTGGAGTAGCACTGATGTGATGAATTACTTTGCATGGGAGAAAATCCC
TCCACCATCTTAAACCCTGGCCACTGTGGGAGCCTGTCAAGAAGCACAGGATTTCTGAAGTG
GAAAGATTATAACTGTGATGCAAAGTTACCCTATGTCTGCAAGTTCAAGGACTAGGGCAGGT
GGGAAGTCAGCAGCCTCAGCTTGGCGTGCAGCTCATCATGGACATGAGACCAGTGTGAAGAC
TCACCCTGGAAGAGAATATTCTCCCCAAACTGCCCTACCTGACTACCTTGTCATGATCCTCC
TTCTTTTTCCTTTTTCTTCACCTTCATTTCAGGCTTTTCTCTGTCTTCCATGTCTTGAGATC
TCAGAGAATAATAATAAAAATGTTACTTTATAAAAAAAAAAAAAAAAAAAAAAA

FIGURE 183

</usr/seqdb2/sst/DNA/Dnaseqs.min/ss.DNA56965
<subunit 1 of 1, 175 aa, 1 stop
<MW: 19330, pI: 7.25, NX(S/T): 1
MLPPMALPSVSWMLLSCLILLCQVQGEETQKELPSPRISCPKGSKAYGSPCYALFLSPKSWM
DADLACQKRPSGKLVSVLSGAEGSFVSSLVRSISNSYSYIWIGLHDPTQGSEPDGDGWEWSS
TDVMNYFAWEKNPSTILNPGHCGSLSRSTGFLKWKDYNCDAKLPYVCKFKD

Important features:
Signal peptide:
amino acids 1-26

C-type lectin domain signature.
amino acids 146-171

FIGURE 184

CCAGTCTGTCGCCACCTCACTTGGTGTCTGCTGTCCCCGCCAGGCAAGCCTGGGGTGAGAGC
ACAGAGGAGTGGGCCGGGACCATGCGGGGACGCGGCTGGCGCTCCTGGCGCTGGTGCTGGC
TGCCTGCGGAGAGCTGGCGCCGGCCCTGCGCTGCTACGTCTGTCCGGAGCCCACAGGAGTGT
CGGACTGTGTCACCATCGCCACCTGCACCACCAACGAAACCATGTGCAAGACCACACTCTAC
TCCCGGGAGATAGTGTACCCCTTCCAGGGGGACTCCACGGTGACCAAGTCCTGTGCCAGCAA
GTGTAAGCCCTCGGATGTGGATGGCATCGGCCAGACCCTGCCCGTGTCCTGCTGCAATACTG
AGCTGTGCAATGTAGACGGGGCGCCCGCTCTGAACAGCCTCCACTGCGGGCCCTCACGCTC
CTCCCACTCTTGAGCCTCCGACTGTAGAGTCCCCGCCCACCCCATGGCCCTATGCGGCCCA
GCCCCGAATGCCTTGAAGAAGTGCCCCCTGCACCAGGAAAAAAAAAAAAAAAAA

FIGURE 185

</usr/seqdb2/sst/DNA/Dnaseqs.min/ss.DNA56405
<subunit 1 of 1, 125 aa, 1 stop
<MW: 13115, pI: 5.90, NX(S/T): 1
MRGTRLALLALVLAACGELAPALRCYVCPEPTGVSDCVTIATCTTNETMCKTTLYSREIVYP
FQGDSTVTKSCASKCKPSDVDGIGQTLPVSCCNTELCNVDGAPALNSLHCGALTLLPLLSLRL

Important features:

Signal peptide:

amino acids 1-17

N-glycosylation site.

amino acids 46-49

FIGURE 186

CTGCAGTCAGGACTCTGGGACCGCAGGGGGCTCCCGGACCCTGACTCTGCAGCCGAACCGGC
ACGGTTTCGTGGGGACCCAGGCTTGCAAAGTGACGGTCATTTTCTCTTTCTTTCTCCCTCTT
GAGTCCTTCTGAG<u>ATG</u>ATGGCTCTGGGCGCAGCGGGAGCTACCCGGGTCTTTGTCGCGATGG
TAGCGGCGGCTCTCGGCGGCCACCCTCTGCTGGGAGTGAGCGCCACCTTGAACTCGGTTCTC
AATTCCAACGCTATCAAGAACCTGCCCCCACCGCTGGGCGGCGCTGCGGGGCACCCAGGCTC
TGCAGTCAGCGCCGCGCCGGGAATCCTGTACCCGGGCGGGAATAAGTACCAGACCATTGACA
ACTACCAGCCGTACCCGTGCGCAGAGGACGAGGAGTGCGGCACTGATGAGTACTGCGCTAGT
CCCACCCGCGGAGGGGACGCAGGCGTGCAAATCTGTCTCGCCTGCAGGAAGCGCCGAAAACG
CTGCATGCGTCACGCTATGTGCTGCCCCGGGAATTACTGCAAAAATGGAATATGTGTGTCTT
CTGATCAAAATCATTTCCGAGGAGAAATTGAGGAAACCATCACTGAAAGCTTTGGTAATGAT
CATAGCACCTTGGATGGGTATTCCAGAAGAACCACCTTGTCTTCAAAAATGTATCACACCAA
AGGACAAGAAGGTTCTGTTTGTCTCCGGTCATCAGACTGTGCCTCAGGATTGTGTTGTGCTA
GACACTTCTGGTCCAAGATCTGTAAACCTGTCCTGAAAGAAGGTCAAGTGTGTACCAAGCAT
AGGAGAAAAGGCTCTCATGGACTAGAAATATTCCAGCGTTGTTACTGTGGAGAAGGTCTGTC
TTGCCGGATACAGAAAGATCACCATCAAGCCAGTAATTCTTCTAGGCTTCACACTTGTCAGA
GACAC<u>TAA</u>CCAGCTATCCAAATGCAGTGAACTCCTTTTATATAATAGATGCTATGAAAACC
TTTTATGACCTTCATCAACTCAATCCTAAGGATATACAAGTTCTGTGGTTTCAGTTAAGCAT
TCCAATAACACCTTCCAAAAACCTGGAGTGTAAGAGCTTTGTTTCTTTATGGAACTCCCCTG
TGATTGCAGTAAATTACTGTATTGTAAATTCTCAGTGTGGCACTTACCTGTAAATGCAATGA
AACTTTTAATTATTTTTCTAAAGGTGCTGCACTGCCTATTTTTCCTCTTGTTATGTAAATTT
TTGTACACATTGATTGTTATCTTGACTGACAAATATTCTATATTGAACTGAAGTAAATCATT
TCAGCTTATAGTTCTTAAAAGCATAACCCTTTACCCCATTTAATTCTAGAGTCTAGAACGCA
AGGATCTCTTGGAATGACAAATGATAGGTACCTAAAATGTAACATGAAAATACTAGCTTATT
TTCTGAAATGTACTATCTTAATGCTTAATTATATTTCCCTTTAGGCTGTGATAGTTTTTGA
AATAAAATTTAACATTTAAAAAAAAAAAAA

FIGURE 187

</usr/seqdb2/sst/DNA/Dnaseqs.min/ss.DNA57530
<subunit 1 of 1, 266 aa, 1 stop
<MW: 28672, pI: 8.85, NX(S/T): 1

MMALGAAGATRVFVAMVAAALGGHPLLGVSATLNSVLNSNAIKNLPPPLGGAAGHPGSAVSA
APGILYPGGNKYQTIDNYQPYPCAEDEECGTDEYCASPTRGGDAGVQICLACRKRRKRCMRH
AMCCPGNYCKNGICVSSDQNHFRGEIEETITESFGNDHSTLDGYSRRTTLSSKMYHTKGQEG
SVCLRSSDCASGLCCARHFWSKICKPVLKEGQVCTKHRRKGSHGLEIFQRCYCGEGLSCRIQ
KDHHQASNSSRLHTCQRH

Important features:
Signal peptide:
amino acids 1-23

N-glycosylation site.
amino acids 256-259

Fungal Zn(2)-Cys(6) binuclear cluster domain
amino acids 110-126

FIGURE 188

TGTGTTTCCCTGCAGTCAGAATTTGGGACNGCAGGGGTTCCCGGACCTGATTTTGCAGCGGA
ACGGGAAGGTTTTGTGGGACCCAGGTTGAAATGACGGTCATTTTTTTTTCTTTCTCCTTCNG
GAGTCCTTNTGAGANGATGGTTTTGGGCGCAGCGGGAGCTAACCCGGTTTTTTGTNGCGATG
GTAGCGGCGGTTTTCGGCGGCCACCTTNTGCTGGGAGTGAGCGCCACCTTGAATCGGTTTTC
AATTCCAACGNTATCAAGAACCTGCCCCACCGNTGGGCGGCGCTGCGGGGCACCCAGGNTT
TGCAGTCAGCGCCGCGCCGGGAATCCTGTACCCGGGCGGGAATAAGTACCAGACCATTGACA
ATTACCAGCCGTACCCGTGCGCAGAGGACGAGGAGTGCGGCACTGATGAGTACTGCGCTAGT
CCCACCCGCGGAGGGGANGCGGGCGTGCAAATNTGTNTNGCCTGCAGGAAGCGCCGAAAACG
CTGCATGCGTCANGCTATGTGCTGCCCCGGGAATTACTGCAAAAATGGAATATGTGTGTNTT
CTGATCAAAATCATTTCCGAGGAGAAATTGAGGAAACCATCACTGAAAGCTTTGGTAATGAT
CATAGCACCTTGGATGGG

FIGURE 189

```
GAGGAACCTACCGGTACCGGCCGCGCGCTGGTAGTCGCCGGTGTGGCTGCACCTCACCAATCCCGTGCGCCGCGG
CTGGGCCGTCGGAGAGTGCGTGTGCTTCTCTCCTGCACGCGGTGCTTGGGCTCGGCCAGGCGGGGTCCGCCGCCA
GGGTTTGAGGATGGGGGAGTAGCTACAGGAAGCGACCCCGCGATGGCAAGGTATATTTTTGTGGAATGAAAAGGA
AGTATTAGAAATGAGCTGAAGACCATTCACAGATTAATATTTTTGGGGACAGATTTGTGATGCTTGATTCACCCT
TGAAGTAATGTAGACAGAAGTTCTCAAATTTGCATATTACATCAACTGGAACCAGCAGTGAATCTTAATGTTCAC
TTAAATCAGAACTTGCATAAGAAAGAGAATGGGAGTCTGGTTAAATAAAGATGACTATATCAGAGACTTGAAAAG
GATCATTCTCTGTTTTCTGATAGTGTATATGGCCATTTTAGTGGGCACAGATCAGGATTTTTACAGTTTACTTGG
AGTGTCCAAAACTGCAAGCAGTAGAGAAATAAGACAAGCTTTCAAGAAATTGGCATTGAAGTTACATCCTGATAA
AAACCCGAATAACCCAAATGCACATGGCGATTTTTAAAAATAAATAGAGCATATGAAGTACTCAAAGATGAAGA
TCTACGGAAAAAGTATGACAAATATGGAGAAAAGGGACTTGAGGATAATCAAGGTGGCCAGTATGAAAGCTGGAA
CTATTATCGTTATGATTTTGGTATTTATGATGATGATCCTGAAATCATAACATTGGAAAGAAGAGAATTTGATGC
TGCTGTTAATTCTGGAGAACTGTGGTTTGTAAATTTTTACTCCCCAGGCTGTTCACACTGCCATGATTTAGCTCC
CACATGGAGAGACTTTGCTAAAGAAGTGGATGGGTTACTTCGAATTGGAGCTGTTAACTGTGGTGATGATAGAAT
GCTTTGCCGAATGAAAGGAGTCAACAGCTATCCCAGTCTCTTCATTTTTCGGTCTGGAATGGCCCCAGTGAAATA
TCATGGAGACAGATCAAAGGAGAGTTTAGTGAGTTTTGCAATGCAGCATGTTAGAAGTACAGTGACAGAACTTTG
GACAGGAAATTTTGTCAACTCCATACAAACTGCTTTTGCTGCTGGTATTGGCTGGCTGATCACTTTTTGTTCAAA
AGGAGGAGATTGTTTGACTTCACAGACACGACTCAGGCTTAGTGGCATGTTGTTTCTCAACTCATTGGATGCTAA
AGAAATATATTTGGAAGTAATACATAATCTTCCAGATTTTGAACTACTTTCGGCAAACACACTAGAGGATCGTTT
GGCTCATCATCGGTGGCTGTTATTTTTTCATTTTGGAAAAAATGAAAATTCAAATGATCCTGAGCTGAAAAAACT
AAAAACTCTACTTAAAAATGATCATATTCAAGTTGGCAGGTTTGACTGTTCCTCTGCACCAGACATCTGTAGTAA
TCTGTATGTTTTTCAGCCGTCTCTAGCAGTATTTAAAGGACAAGGAACCAAAGAATATGAAATTCATCATGGAAA
GAAGATTCTATATGATATACTTGCCTTTGCCAAAGAAAGTGTGAATTCTCATGTTACCACGCTTGGACCTCAAAA
TTTTCCTGCCAATGACAAAGAACCATGGCTTGTTGATTTCTTTGCCCCCTGGTGTCCACCATGTCGAGCTTTACT
ACCAGAGTTACGAAGAGCATCAAATCTTCTTTATGGTCAGCTTAAGTTTGGTACACTAGATTGTACAGTTCATGA
GGGACTCTGTAACATGTATAACATTCAGGCTTATCCAACAACAGTGGTATTCAACCAGTCCAACATTCATGAGTA
TGAAGGACATCACTCTGCTGAACAAATCTTGGAGTTCATAGAGGATCTTATGAATCCTTCAGTGGTCTCCCTTAC
ACCCACCACCTTCAACGAACTAGTTACACAAAGAAAACACAACGAAGTCTGGATGGTTGATTTCTATTCTCCGTG
GTGTCATCCTTGCCAAGTCTTAATGCCAGAATGGAAAAGAATGGCCCGGACATTAACTGGACTGATCAACGTGGG
CAGTATAGATTGCCAACAGTATCATTCTTTTGTGCCCAGGAAAACGTTCAAAGATACCCTGAGATAAGATTTTT
TCCCCCAAAATCAAATAAAGCTTATCAGTATCACAGTTACAATGGTTGGAATAGGGATGCTTATTCCCTGAGAAT
CTGGGGTCTAGGATTTTTACCTCAAGTATCCACAGATCTAACACCTCAGACTTTCAGTGAAAAAGTTCTACAAGG
GAAAAATCATTGGGTGATTGATTTCTATGCTCCTTGGTTGGACCTTGCCAGAATTTTGCTCCAGAATTTGAGCT
CTTGGCTAGGATGATTAAAGGAAAAGTGAAAGCTGGAAAAGTAGACTGTCAGGCTTATGCTCAGACATGCCAGAA
AGCTGGGATCAGGGCCTATCCAACTGTTAAGTTTTATTTCTACGAAAGAGCAAAGAGAAATTTTCAAGAAGAGCA
GATAAATACCAGAGATGCAAAAGCAATCGCTGCCTTAATAAGTGAAAAATTGGAAACTCTCCGAAATCAAGGCAA
GAGGAATAAGGATGAACTTTGATAATGTTGAAGATGAAGAAAAAGTTTAAAAGAAATTCTGACAGATGACATCAG
AAGACACCTATTTAGAATGTTACATTTATGATGGGAATGAATGAACATTATCTTAGACTTGCAGTTGTACTGCCA
GAATTATCTACAGCACTGGTGTAAAAGAAGGGTCTGCAAACTTTTTCTGTAAAGGGCCGGTTTATAAATATTTTA
GACTTTGCAGGCTATAATATATGGTTCACACATGAGAACAAGAATAGAGTCATCATGTATTCTTTGTTATTTGCT
TTTAACAACCTTTAAAAAATATTAAAACGATTCTTAGCTCAGAGCCATACAAAAGTAGGCTGGATTCAGTCCATG
GACCATAGATTGCTGTCCCCCTCGACGGACTTATAATGTTTCAGGTGGCTGGCTTGAACATGAGTCTGCTGTGCT
ATCTACATAAATGTCTAAGTTGTATAAAGTCCACTTTCCCTTCACGTTTTTGGCTGACCTGAAAAGAGGTAACT
TAGTTTTGGTCACTTGTTCTCCTAAAAATGCTATCCCTAACCATATATTTATATTTCGTTTTAAAAACACCCAT
GATGTGGCACAGTAAACAAACCCTGTTATGCTGTATTATTATGAGGAGATTCTTCATTGTTTTCTTTCCTTCTCA
AAGGTTGAAAAAATGCTTTTAATTTTTCACAGCCGAGAAACAGTGCAGCAGTATATGTGCACACAGTAAGTACAC
AAATTTGAGCAACAGTAAGTGCACAAATTCTGTAGTTTGCTGTATCATCCAGGAAAACCTGAGGGAAAAAATTA
TAGCAATTAACTGGGCATTGTAGAGTATCCTAAATATGTTATCAAGTATTTAGAGTTCTATATTTAAAGATATA
TGTGTTCATGTATTTTCTGAAATTGCTTTCATAGAAATTTTCCCACTGATAGTTGATTTTGAGGCATCTAATAT
TTACATATTTGCCTTCTGAACTTTGTTTTGACCTGTATCCTTTATTTACATTGGGTTTTTCTTTCATAGTTTTGG
TTTTTCACTCCTGTCCAGTCTATTTATTATTCAAATAGGAAAATTACTTTACAGGTTGTTTTACTGTAGCTTAT
AATGATACTGTAGTTATTCCAGTTACTAGTTTACTGTCAGAGGGCTGCCTTTTTCAGATAAATATTGACATAATA
ACTGAAGTTATTTTTATAAGAAAATCAAGTATATAAATCTAGGAAAGGGATCTTCTAGTTTCTGTGTTGTTTAGA
CTCAAAGAATCACAAATTTGTCAGTAACATGTAGTTGTTTAGTTATAATTCAGAGTGTACAGAATGGTAAAAATT
CCAATCAGTCAAAAGAGGTCAATGAATTAAAAGGCTTGCAACTTTTTCAAAAAAAAAAAAAAAA
```

FIGURE 190

```
</usr/seqdb2/sst/DNA/Dnaseqs.min/ss.DNA56439
<subunit 1 of 1, 747 aa, 1 stop
<MW: 86127, pI: 7.46, NX(S/T): 2

MGVWLNKDDYIRDLKRIILCFLIVYMAILVGTDQDFYSLLGVSKTASSREIRQAFKKLALKL
HPDKNPNNPNAHGDFLKINRAYEVLKDEDLRKKYDKYGEKGLEDNQGGQYESWNYYRYDFGI
YDDDPEIITLERREFDAAVNSGELWFVNFYSPGCSHCHDLAPTWRDFAKEVDGLLRIGAVNC
GDDRMLCRMKGVNSYPSLFIFRSGMAPVKYHGDRSKESLVSFAMQHVRSTVTELWTGNFVNS
IQTAFAAGIGWLITFCSKGGDCLTSQTRLRLSGMLFLNSLDAKEIYLEVIHNLPDFELLSAN
TLEDRLAHHRWLLFFHFGKNENSNDPELKKLKTLLKNDHIQVGRFDCSSAPDICSNLYVFQP
SLAVFKGQGTKEYEIHHGKKILYDILAFAKESVNSHVTTLGPQNFPANDKEPWLVDFFAPWC
PPCRALLPELRRASNLLYGQLKFGTLDCTVHEGLCNMYNIQAYPTTVVFNQSNIHEYEGHHS
AEQILEFIEDLMNPSVVSLTPTTFNELVTQRKHNEVWMVDFYSPWCHPCQVLMPEWKRMART
LTGLINVGSIDCQQYHSFCAQENVQRYPEIRFFPPKSNKAYQYHSYNGWNRDAYSLRIWGLG
FLPQVSTDLTPQTFSEKVLQGKNHWVIDFYAPWCGPCQNFAPEFELLARMIKGKVKAGKVDC
QAYAQTCQKAGIRAYPTVKFYFYERAKRNFQEEQINTRDAKAIAALISEKLETLRNQGKRNKDEL
```

Important features:
Endoplasmic reticulum targeting sequence.
amino acids 744-747

Cytochrome c family heme-binding site signature.
amino acids 158-163

Nt-dnaJ domain signature.
amino acids 77-96

N-glycosylation site.
amino acids 484-487

FIGURE 191

AGACAGTACCTCCTCCCTAGGACTACACAAGGACTGAACCAGAAGGAAGAGGACAGAGCAAA
GCCATGAACATCATCCTAGAAATCCTTCTGCTTCTGATCACCATCATCTACTCCTACTTGGA
GTCGTTGGTGAAGTTTTTCATTCCTCAGAGGAGAAAATCTGTGGCTGGGGAGATTGTTCTCA
TTACTGGAGCTGGGCATGGAATAGGCAGGCAGACTACTTATGAATTTGCAAAACGACAGAGC
ATATTGGTTCTGTGGGATATTAATAAGCGCGGTGTGGAGGAAACTGCAGCTGAGTGCCGAAA
ACTAGGCGTCACTGCGCATGCGTATGTGGTAGACTGCAGCAACAGAGAAGAGATCTATCGCT
CTCTAAATCAGGTGAAGAAAGAAGTGGGTGATGTAACAATCGTGGTGAATAATGCTGGGACA
GTATATCCAGCCGATCTTCTCAGCACCAAGGATGAAGAGATTACCAAGACATTTGAGGTCAA
CATCCTAGGACATTTTTGGATCACAAAAGCACTTCTTCCATCGATGATGGAGAGAAATCATG
GCCACATCGTCACAGTGGCTTCAGTGTGCGGCCACGAAGGGATTCCTTACCTCATCCCATAT
TGTTCCAGCAAATTTGCCGCTGTTGGCTTTCACAGAGGTCTGACATCAGAACTTCAGGCCTT
GGGAAAAACTGGTATCAAAACCTCATGTCTCTGCCCAGTTTTTGTGAATACTGGGTTCACCA
AAAATCCAAGCACAAGATTATGGCCTGTATTGGAGACAGATGAAGTCGTAAGAAGTCTGATA
GATGGAATACTTACCAATAAGAAAATGATTTTTGTTCCATCGTATATCAATATCTTTCTGAG
ACTACAGAAGTTTCTTCCTGAACGCGCCTCAGCGATTTTAAATCGTATGCAGAATATTCAAT
TTGAAGCAGTGGTTGGCCACAAAATCAAAATGAAATGAATAAATAAGCTCCAGCCAGAGATG
TATGCATGATAATGATATGAATAGTTTCGAATCAATGCTGCAAAGCTTTATTTCACATTTTT
TCAGTCCTGATAATATTAAAAACATTGGTTTGGCACTAGCAGCAGTCAAACGAACAAGATTA
ATTACCTGTCTTCCTGTTTCTCAAGAATATTTACGTAGTTTTTCATAGGTCTGTTTTTCCTT
TCATGCCTCTTAAAAACTTCTGTGCTTACATAAACATACTTAAAAGGTTTTCTTTAAGATAT
TTTATTTTTCCATTTAAAGGTGGACAAAAGCTACCTCCCTAAAAGTAAATACAAAGAGAACT
TATTTACACAGGGAAGGTTTAAGACTGTTCAAGTAGCATTCCAATCTGTAGCCATGCCACAG
AATATCAACAAGAACACAGAATGAGTGCACAGCTAAGAGATCAAGTTTCAGCAGGCAGCTTT
ATCTCAACCTGGACATATTTTAAGATTCAGCATTTGAAAGATTTCCCTAGCCTCTTCCTTTT
TCATTAGCCCAAAACGGTGCAACTCTATTCTGGACTTTATTACTTGATTCTGTCTTCTGTAT
AACTCTGAAGTCCACCAAAAGTGGACCCTCTATATTTCCTCCCTTTTATAGTCTTATAAGA
TACATTATGAAAGGTGACCGACTCTATTTTAAATCTCAGAATTTTAAGTTCTAGCCCCATGA
TAACCTTTTTCTTTGTAATTTATGCTTTCATATATCCTTGGTCCCAGAGATGTTTAGACAAT
TTTAGGCTCAAAAATTAAAGCTAACACAGGAAAAGGAACTGTACTGGCTATTACATAAGAAA
CAATGGACCCAAGAGAAGAA

FIGURE 192

</usr/seqdb2/sst/DNA/Dnaseqs.min/ss.DNA56409
<subunit 1 of 1, 300 aa, 1 stop
<MW: 33655, pI: 9.31, NX(S/T): 1

MNIILEILLLLITIIYSYLESLVKFFIPQRRKSVAGEIVLITGAGHGIGRQTTYEFAKRQSI
LVLWDINKRGVEETAAECRKLGVTAHAYVVDCSNREEIYRSLNQVKKEVGDVTIVVNNAGTV
YPADLLSTKDEEITKTFEVNILGHFWITKALLPSMMERNHGHIVTVASVCGHEGIPYLIPYC
SSKFAAVGFHRGLTSELQALGKTGIKTSCLCPVFVNTGFTKNPSTRLWPVLETDEVVRSLID
GILTNKKMIFVPSYINIFLRLQKFLPERASAILNRMQNIQFEAVVGHKIKMK

Important features:

Signal peptide:

amino acids 1-19 cAMP- and cGMP-dependent protein kinase phosphorylation site.

amino acids 30-33 and 58-61

Short-chain alcohol dehydrogenase family protein amino acids 165-202, 37-49, 112-122 and 210-219

FIGURE 193

CGGCGGCGGCTGCGGGCGCGAGGTGAGGGGCGCGAGGTGAGGGGCGCGAGGTTCCCAGCAGG
ATGCCCCGGCTCTGCAGGAAGCTGAAGTGAGAGGCCCGGAGAGGGCCCAGCCCGCCCGGGGC
AGGATGACCAAGGCCCGGCTGTTCCGGCTGTGGCTGGTGCTGGGGTCGGTGTTCATGATCCT
GCTGATCATCGTGTACTGGGACAGCGCAGGCGCCGCGCACTTCTACTTGCACACGTCCTTCT
CTAGGCCGCACACGGGGCCGCCGCTGCCCACGCCCGGGCCGGACAGGGACAGGGAGCTCACG
GCCGACTCCGATGTCGACGAGTTTCTGGACAAGTTTCTCAGTGCTGGCGTGAAGCAGAGCGA
CCTTCCCAGAAAGGAGACGGAGCAGCCGCCTGCGCCGGGGAGCATGGAGGAGAGCGTGAGAG
GCTACGACTGGTCCCCGCGCGACGCCCGGCGCAGCCCAGACCAGGGCCGGCAGCAGGCGGAG
CGGAGGAGCGTGCTGCGGGGCTTCTGCGCCAACTCCAGCCTGGCCTTCCCCACCAAGGAGCG
CGCATTCGACGACATCCCCAACTCGGAGCTGAGCCACCTGATCGTGGACGACCGGCACGGGG
CCATCTACTGCTACGTGCCCAAGGTGGCCTGCACCAACTGGAAGCGCGTGATGATCGTGCTG
AGCGGAAGCCTGCTGCACCGCGGTGCGCCCTACCGCGACCCGCTGCGCATCCCGCGCGAGCA
CGTGCACAACGCCAGCGCGCACCTGACCTTCAACAAGTTCTGGCGCCGCTACGGGAAGCTCT
CCCGCCACCTCATGAAGGTCAAGCTCAAGAAGTACACCAAGTTCCTCTTCGTGCGCGACCCC
TTCGTGCGCCTGATCTCCGCCTTCCGCAGCAAGTTCGAGCTGGAGAACGAGGAGTTCTACCG
CAAGTTCGCCGTGCCCATGCTGCGGCTGTACGCCAACCACACCAGCCTGCCCGCCTCGGCGC
GCGAGGCCTTCCGCGCTGGCCTCAAGGTGTCCTTCGCCAACTTCATCCAGTACCTGCTGGAC
CCGCACACGGAGAAGCTGGCGCCCTTCAACGAGCACTGGCGGCAGGTGTACCGCCTCTGCCA
CCCGTGCCAGATCGACTACGACTTCGTGGGGAAGCTGGAGACTCTGGACGAGGACGCCGCGC
AGCTGCTGCAGCTACTCCAGGTGGACCGGCAGCTCCGCTTCCCCCCGAGCTACCGGAACAGG
ACCGCCAGCAGCTGGGAGGAGGACTGGTTCGCCAAGATCCCCCTGGCCTGGAGGCAGCAGCT
GTATAAACTCTACGAGGCCGACTTTGTTCTCTTCGGCTACCCCAAGCCCGAAAACCTCCTCC
GAGACTGAAAGCTTTCGCGTTGCTTTTTCTCGCGTGCCTGGAACCTGACGCACGCGCACTCC
AGTTTTTTTATGACCTACGATTTTGCAATCTGGGCTTCTTGTTCACTCCACTGCCTCTATCC
ATTGAGTACTGTATCGATATTGTTTTTAAGATTAATATATTTCAGGTATTTAATACGA

FIGURE 194

```
</usr/seqdb2/sst/DNA/Dnaseqs.min/ss.DNA56112
<subunit 1 of 1, 414 aa, 1 stop
<MW: 48414, pI: 9.54, NX(S/T): 4
MTKARLFRLWLVLGSVFMILLIIVYWDSAGAAHFYLHTSFSRPHTGPPLPTPGPDRDRELTA
DSDVDEFLDKFLSAGVKQSDLPRKETEQPPAPGSMEESVRGYDWSPRDARRSPDQGRQQAER
RSVLRGFCANSSLAFPTKERAFDDIPNSELSHLIVDDRHGAIYCYVPKVACTNWKRVMIVLS
GSLLHRGAPYRDPLRIPREHVHNASAHLTFNKFWRRYGKLSRHLMKVKLKKYTKFLFVRDPF
VRLISAFRSKFELENEEFYRKFAVPMLRLYANHTSLPASAREAFRAGLKVSFANFIQYLLDP
HTEKLAPFNEHWRQVYRLCHPCQIDYDFVGKLETLDEDAAQLLQLLQVDRQLRFPPSYRNRT
ASSWEEDWFAKIPLAWRQQLYKLYEADFVLFGYPKPENLLRD
```

Important features:
Signal peptide:
amino acids 1-31

N-glycosylation sites.
amino acids 134-137, 209-212, 280-283 and 370-373

TNFR/NGFR family cysteine-rich region protein
amino acids 329-332

FIGURE 195

TCGGGCCAGAATTCGGCACGAGGCGGCACGAGGGCGACGGCCTCACGGGGCTTTGGAGGTGA
AAGAGGCCCAGAGTAGAGAGAGAGAGAGACCGACGTACACGGGATGGCTACGGGAACGCGCT
ATGCCGGGAAGGTGGTGGTCGTGACCGGGGGCGGGCGCGGCATCGGAGCTGGGATCGTGCGC
GCCTTCGTGAACAGCGGGGCCCGAGTGGTTATCTGCGACAAGGATGAGTCTGGGGGCCGGGC
CCTGGAGCAGGAGCTCCCTGGAGCTGTCTTTATCCTCTGTGATGTGACTCAGGAAGATGATG
TGAAGACCCTGGTTTCTGAGACCATCCGCCGATTTGGCCGCCTGGATTGTGTTGTCAACAAC
GCTGGCCACCACCCACCCCCACAGAGGCCTGAGGAGACCTCTGCCCAGGGATTCCGCCAGCT
GCTGGAGCTGAACCTACTGGGGACGTACACCTTGACCAAGCTCGCCCTCCCCTACCTGCGGA
AGAGTCAAGGGAATGTCATCAACATCTCCAGCCTGGTGGGGGCAATCGGCCAGGCCCAGGCA
GTTCCCTATGTGGCCACCAAGGGGGCAGTAACAGCCATGACCAAAGCTTTGGCCCTGGATGA
AAGTCCATATGGTGTCCGAGTCAACTGTATCTCCCCAGGAAACATCTGGACCCCGCTGTGGG
AGGAGCTGGCAGCCTTAATGCCAGACCCTAGGGCCACAATCCGAGAGGGCATGCTGGCCCAG
CCACTGGGCCGCATGGGCCAGCCCGCTGAGGTCGGGGCTGCGGCAGTGTTCCTGGCCTCCGA
AGCCAACTTCTGCACGGGCATTGAACTGCTCGTGACGGGGGGTGCAGAGCTGGGGTACGGGT
GCAAGGCCAGTCGGAGCACCCCCGTGGACGCCCCGATATCCCTTCCTGATTTCTCTCATTT
CTACTTGGGGCCCCCTTCCTAGGACTCTCCCACCCCAAACTCCAACCTGTATCAGATGCAGC
CCCCAAGCCCTTAGACTCTAAGCCCAGTTAGCAAGGTGCCGGGTCACCCTGCAGGTTCCCAT
AAAAACGATTTGCAGCC

FIGURE 196

</usr/seqdb2/sst/DNA/Dnaseqs.min/ss.DNA56045
<subunit 1 of 1, 270 aa, 1 stop
<MW: 28317, pI: 6.00, NX(S/T): 1
MATGTRYAGKVVVVTGGGRGIGAGIVRAFVNSGARVVICDKDESGGRALEQELPGAVFILCD
VTQEDDVKTLVSETIRRFGRLDCVVNNAGHHPPPQRPEETSAQGFRQLLELNLLGTYTLTKL
ALPYLRKSQGNVINISSLVGAIGQAQAVPYVATKGAVTAMTKALALDESPYGVRVNCISPGN
IWTPLWEELAALMPDPRATIREGMLAQPLGRMGQPAEVGAAAVFLASEANFCTGIELLVTGG
AELGYGCKASRSTPVDAPDIPS

Important features:
N-glycosylation site.
amino acids 138-141

Short-chain alcohol dehydrogenase family protein
amino acids 10-22, 81-91, 134-171 and 176-185

FIGURE 197

AGGCGGGCAGCAGCTGCAGGCTGACCTTGCAGCTTGGCGGAATGGACTGGCCTCACAACCTG
CTGTTTCTTCTTACCATTTCCATCTTCCTGGGGCTGGGCCAGCCCAGGAGCCCCAAAAGCAA
GAGGAAGGGGCAAGGGCGGCCTGGGCCCCTGGCCCCTGGCCCTCACCAGGTGCCACTGGACC
TGGTGTCACGGATGAAACCGTATGCCCGCATGGAGGAGTATGAGAGGAACATCGAGGAGATG
GTGGCCCAGCTGAGGAACAGCTCAGAGCTGGCCCAGAGAAAGTGTGAGGTCAACTTGCAGCT
GTGGATGTCCAACAAGAGGAGCCTGTCTCCCTGGGGCTACAGCATCAACCACGACCCCAGCC
GTATCCCCGTGGACCTGCCGGAGGCACGGTGCCTGTGTCTGGGCTGTGTGAACCCCTTCACC
ATGCAGGAGGACCGCAGCATGGTGAGCGTGCCGGTGTTCAGCCAGGTTCCTGTGCGCCGCCG
CCTCTGCCCGCCACCGCCCCGCACAGGGCCTTGCCGCCAGCGCGCAGTCATGGAGACCATCG
CTGTGGGCTGCACCTGCATCTTCTGAATCACCTGGCCCAGAAGCCAGGCCAGCAGCCCGAGA
CCATCCTCCTTGCACCTTTGTGCCAAGAAAGGCCTATGAAAAGTAAACACTGACTTTTGAAA
GCAAG

FIGURE 198

</usr/seqdb2/sst/DNA/Dnaseqs.min/ss.DNA59294
<subunit 1 of 1, 180 aa, 1 stop
<MW: 20437, pI: 9.58, NX(S/T): 1
MDWPHNLLFLLTISIFLGLGQPRSPKSKRKGQGRPGPLAPGPHQVPLDLVSRMKPYARMEEY
ERNIEEMVAQLRNSSELAQRKCEVNLQLWMSNKRSLSPWGYSINHDPSRIPVDLPEARCLCL
GCVNPFTMQEDRSMVSVPVFSQVPVRRRLCPPPPRTGPCRQRAVMETIAVGCTCIF

Important features:
Signal peptide:
amino acids 1-20

N-glycosylation site.
amino acids 75-78

Homologous region to IL-17
amino acids 96-180.

FIGURE 199

```
GCGCCGCCAGGCGTAGGCGGGGTGGCCCTTGCGTCTCCCGCTTCCTTGAAAAACCCGGCGGG
CGAGCGAGGCTGCGGGCCGGCCGCTGCCCTTCCCCACACTCCCCGCCGAGAAGCCTCGCTCG
GCGCCCAACATGGCGGGTGGGCGCTGCGGCCCGCAGCTAACGGCGCTCCTGGCCGCCTGGAT
CGCGGCTGTGGCGGCGACGGCAGGCCCCGAGGAGGCCGCGCTGCCGCCGGAGCAGAGCCGGG
TCCAGCCCATGACCGCCTCCAACTGGACGCTGGTGATGGAGGGCGAGTGGATGCTGAAATTT
TACGCCCCATGGTGTCCATCCTGCCAGCAGACTGATTCAGAATGGGAGGCTTTTGCAAAGAA
TGGTGAAATACTTCAGATCAGTGTGGGAAGGTAGATGTCATTCAAGAACCAGGTTTGAGTG
GCCGCTTCTTTGTCACCACTCTCCCAGCATTTTTTCATGCAAAGGATGGGATATTCCGCCGT
TATCGTGGCCCAGGAATCTTCGAAGACCTGCAGAATTATATCTTAGAGAAGAAATGGCAATC
AGTCGAGCCTCTGACTGGCTGGAAATCCCCAGCTTCTCTAACGATGTCTGGAATGGCTGGTC
TTTTTAGCATCTCTGGCAAGATATGGCATCTTCACAACTATTTCACAGTGACTCTTGGAATT
CCTGCTTGGTGTTCTTATGTGTTTTTCGTCATAGCCACCTTGGTTTTTGGCCTTTTTATGGG
TCTGGTCTTGGTGGTAATATCAGAATGTTTCTATGTGCCACTTCCAAGGCATTTATCTGAGC
GTTCTGAGCAGAATCGGAGATCAGAGGAGGCTCATAGAGCTGAACAGTTGCAGGATGCGGAG
GAGGAAAAGATGATTCAAATGAAGAAGAAACAAAGACAGCCTTGTAGATGATGAAGAAGA
GAAAGAAGATCTTGGCGATGAGGATGAAGCAGAGGAAGAAGAGGAGGAGGACAACTTGGCTG
CTGGTGTGGATGAGGAGAGAAGTGAGGCCAATGATCAGGGGCCCCCAGGAGAGGACGGTGTG
ACCCGGGAGGAAGTAGAGCCTGAGGAGGCTGAAGAAGGCATCTCTGAGCAACCCTGCCCAGC
TGACACAGAGGTGGTGGAAGACTCCTTGAGGCAGCGTAAAAGTCAGCATGCTGACAAGGGAC
TGTAGATTTAATGATGCGTTTTCAAGAATACACACCAAAACAATATGTCAGCTTCCCTTTGG
CCTGCAGTTTGTACCAAATCCTTAATTTTTCCTGAATGAGCAAGCTTCTCTTAAAAGATGCT
CTCTAGTCATTTGGTCTCATGGCAGTAAGCCTCATGTATACTAAGGAGAGTCTTCCAGGTGT
GACAATCAGGATATAGAAAACAAACGTAGTGTTGGGATCTGTTTGGAGACTGGGATGGGAA
CAAGTTCATTTACTTAGGGGTCAGAGAGTCTCGACCAGAGGAGGCCATTCCCAGTCCTAATC
AGCACCTTCCAGAGACAAGGCTGCAGGCCCTGTGAAATGAAAGCCAAGCAGGAGCCTTGGCT
CCTGAGCATCCCCAAAGTGTAACGTAGAAGCCTTGCATCCTTTTCTTGTGTAAAGTATTTAT
TTTTGTCAAATTGCAGGAAACATCAGGCACCACAGTGCATGAAAAATCTTTCACAGCTAGAA
ATTGAAAGGGCCTTGGGTATAGAGAGCAGCTCAGAAGTCATCCCAGCCCTCTGAATCTCCTG
TGCTATGTTTTATTTCTTACCTTTAATTTTTCCAGCATTTCCACCATGGGCATTCAGGCTCT
CCACACTCTTCACTATTATCTCTTGGTCAGAGGACTCCAATAACAGCCAGGTTTACATGAAC
TGTGTTTGTTCATTCTGACCTAAGGGGTTTAGATAATCAGTAACCATAACCCCTGAAGCTGT
GACTGCCAAACATCTCAAATGAAATGTTGTGGCCATCAGAGACTCAAAAGGAAGTAAGGATT
TTACAAGACAGATTAAAAAAAATTGTTTTGTCCAAAATATAGTTGTTGTTGATTTTTTTTT
AAGTTTTCTAAGCAATATTTTTCAAGCCAGAAGTCCTCTAAGTCTTGCCAGTACAAGGTAGT
CTTGTGAAGAAAGTTGAATACTGTTTTGTTTTCATCTCAAGGGGTTCCCTGGGTCTTGAAC
TACTTTAATAATAACTAAAAAACCACTTCTGATTTTCCTTCAGTGATGTGCTTTTGGTGAAA
GAATTAATGAACTCCAGTACCTGAAAGTGAAAGATTTGATTTTGTTTCCATCTTCTGTAATC
TTCCAAAGAATTATATCTTTGTAAATCTCTCAATACTCAATCTACTGTAAGTACCCAGGGAG
GCTAATTTCTTT
```

FIGURE 200

```
</usr/seqdb2/sst/DNA/Dnaseqs.min/ss.DNA56433
<subunit 1 of 1, 349 aa, 1 stop
<MW: 38952, pI: 4.34, NX(S/T): 1
MAGGRCGPQLTALLAAWIAAVAATAGPEEAALPPEQSRVQPMTASNWTLVMEGEWMLKFYAP
WCPSCQQTDSEWEAFAKNGEILQISVGKVDVIQEPGLSGRFFVTTLPAFFHAKDGIFRRYRG
PGIFEDLQNYILEKKWQSVEPLTGWKSPASLTMSGMAGLFSISGKIWHLHNYFTVTLGIPAW
CSYVFFVIATLVFGLFMGLVLVVISECFYVPLPRHLSERSEQNRRSEEAHRAEQLQDAEEEK
DDSNEEENKDSLVDDEEEKEDLGDEDEAEEEEEDNLAAGVDEERSEANDQGPPGEDGVTRE
EVEPEEAEEGISEQPCPADTEVVEDSLRQRKSQHADKGL
```

Important features:

Signal peptide:

amino acids 1-22

Transmembrane domain:

amino acids 191-211

N-glycosylation site.

amino acids 46-49

Thioredoxin family proteins. (homologous region to disulfide isomerase)

amino acids 56-72

Flavodoxin proteins amino acids 173-187

FIGURE 201

```
ATCTGGTTGAACTACTTAAGCTTAATTTGTTAAACTCCGGTAAGTACCTAGCCCACATGATT
TGACTCAGAGATTCTCTTTTGTCCACAGACAGTCATCTCAGGGGCAGAAAGAAAAGAGCTCC
CAAATGCTATATCTATTCAGGGGCTCTCAAGAACAATGGAATATCATCCTGATTTAGAAAAT
TTGGATGAAGATGGATATACTCAATTACACTTCGACTCTCAAAGCAATACCAGGATAGCTGT
TGTTTCAGAGAAAGGATCGTGTGCTGCATCTCCTCCTTGGCGCCTCATTGCTGTAATTTTGG
GAATCCTATGCTTGGTAATACTGGTGATAGCTGTGGTCCTGGGTACCATGGGGGTTCTTTCC
AGCCCTTGTCCTCCTAATTGGATTATATATGAAGAGCTGTTATCTATTCAGCATGTCACT
AAATTCCTGGGATGGAAGTAAAAGACAATGCTGGCAACTGGGCTCTAATCTCCTAAAGATAG
ACAGCTCAAATGAATTGGGATTTATAGTAAAACAAGTGTCTTCCCAACCTGATAATTCATTT
TGGATAGGCCTTTCTCGGCCCCAGACTGAGGTACCATGGCTCTGGGAGGATGGATCAACATT
CTCTTCTAACTTATTTCAGATCAGAACCACAGCTACCCAAGAAAACCCATCTCCAAATTGTG
TATGGATTCACGTGTCAGTCATTTATGACCAACTGTGTAGTGTGCCCTCATATAGTATTTGT
GAGAAGAAGTTTTCAATGTAAGAGGAAGGGTGGAGAAGGAGAGAGAAATATGTGAGGTAGTA
AGGAGGACAGAAAACAGAACAGAAAAGAGTAACAGCTGAGGTCAAGATAAATGCAGAAAATG
TTTAGAGAGCTTGGCCAACTGTAATCTTAACCAAGAAATTGAAGGGAGAGGCTGTGATTTCT
GTATTTGTCGACCTACAGGTAGGCTAGTATTATTTTTCTAGTTAGTAGATCCCTAGACATGG
AATCAGGGCAGCCAAGCTTGAGTTTTTATTTTTTATTTATTTATTTTTTGAGATAGGGTCT
CACTTTGTTACCCAGGCTGGAGTGCAGTGGCACAATCTCGACTCACTGCAGCTATCTCTCGC
CTCAGCCCCTCAAGTAGCTGGGACTACAGGTGCATGCCACCATGCCAGGCTAATTTTTGGTG
TTTTTTGTAGAGACTGGGTTTTGCCATGTTGACCAAGCTGGTCTCTAACTCCTGGGCTTAAG
TGATCTGCCCGCCTTGGCCTCCCAAAGTGCTGGGATTACAGATGTGAGCCACCACACCTGGC
CCCAAGCTTGAATTTTCATTCTGCCATTGACTTGGCATTTACCTTGGGTAAGCCATAAGCGA
ATCTTAATTTCTGGCTCTATCAGAGTTGTTTCATGCTCAACAATGCCATTGAAGTGCACGGT
GTGTTGCCACGATTTGACCCTCAACTTCTAGCAGTATATCAGTTATGAACTGAGGGTGAAAT
ATATTTCTGAATAGCTAAATGAAGAAATGGGAAAAAATCTTCACCACAGTCAGAGCAATTTT
ATTATTTTCATCAGTATGATCATAATTATGATTATCATCTTAGTAAAAGCAGGAACTCCTA
CTTTTTCTTTATCAATTAAATAGCTCAGAGAGTACATCTGCCATATCTCTAATAGAATCTTT
TTTTTTTTTTTTTTTTTTGAGACAGAGTTTCGCTCTTGTTGCCCAGGCTGGAGTGCAACGG
CACGATCTCGGCTCACCGCAACCTCCGCCCCCTGGGTTCAAGCAATTCTCCTGCCTCAGCCT
CCCAAGTAGCTGGGATTACAGTCAGGCACCACCACACCCGGCTAATTTTGTATTTTTTAGT
AGAGACAGGGTTTCTCCATGTCGGTCAGGGTAGTCCCGAACTCCTGACCTCAAGTGATCTGC
CTGCCTCGGCCTCCCAAGTGCTGGGATTACAGGCGTGAGCCACTGCACCCAGCCTAGAATCT
TGTATAATATGTAATTGTAGGGAAACTGCTCTCATAGGAAAGTTTTCTGCTTTTAAATACA
AAAATACATAAAAATACATAAAATCTGATGATGAATATAAAAAAGTAACCAACCTCATTGGA
ACAAGTATTAACATTTGGAATATGTTTATTAGTTTTGTGATGTACTGTTTTACAATTTTT
ACCATTTTTTTCAGTAATTACTGTAAAATGGTATTATTGGAATGAAACTATATTTCCTCATG
TGCTGATTTGTCTTATTTTTTTCATACTTTCCCACTGGTGCTATTTTTATTTCCAATGGATA
TTTCTGTATTACTAGGGAGGCATTTACAGTCCTCTAATGTTGATTAATATGTGAAAAGAAAT
TGTACCAATTTTACTAAATTATGCAGTTTAAAATGGATGATTTTATGTTATGTGGATTTCAT
TTCAATAAAAAAAAAACTCTTATCAAAAAAAAAAAAAAAAAAAAAAAAAAAAAAAAAAAA
```

FIGURE 202

</usr/seqdb2/sst/DNA/Dnaseqs.min/ss.DNA53912
<subunit 1 of 1, 201 aa, 1 stop
<MW: 22563, pI: 4.87, NX(S/T): 1
MEYHPDLENLDEDGYTQLHFDSQSNTRIAVVSEKGSCAASPPWRLIAVILGILCLVILVIAV
VLGTMGVLSSPCPPNWIIYEKSCYLFSMSLNSWDGSKRQCWQLGSNLLKIDSSNELGFIVKQ
VSSQPDNSFWIGLSRPQTEVPWLWEDGSTFSSNLFQIRTTATQENPSPNCVWIHVSVIYDQL
CSVPSYSICEKKFSM Important features:
Type II transmembrane domain:
amino acids 45-65 cAMP- and cGMP-dependent protein kinase phosphorylation site.
amino acids 197-200

N-myristoylation sites.
amino acids 35-40 and 151-156

Homologous region to LDL receptor
amino acids 34-67 and 70-200.

FIGURE 203

```
GGAAGGGGAGGAGCAGGCCACACAGGCACAGGCCGGTGAGGGACCTGCCCAGACCTGGAGGGTCTCGCTCTGTCA
CACAGGCTGGAGTGCAGTGGTGTGATCTTGGCTCATCGTAACCTCCACCTCCCGGGTTCAAGTGATTCTCATGCC
TCAGCCTCCCGAGTAGCTGGGATTACAGGTGGTGACTTCCAAGAGTGACTCCGTCGGAGGAAAATGACTCCCCAG
TCGCTGCTGCAGACGACACTGTTCCTGCTGAGTCTGCTCTTCCTGGTCCAAGGTGCCCACGGCAGGGGCCACAGG
GAAGACTTTCGCTTCTGCAGCCAGCGGAACCAGACACACAGGAGCAGCCTCCACTACAAACCCACACCAGACCTG
CGCATCTCCATCGAGAACTCCGAAGAGGCCCTCACAGTCCATGCCCCTTTCCCTGCAGCCCACCCTGCTTCCCGA
TCCTTCCCTGACCCCAGGGGCCTCTACCACTTCTGCCTCTACTGGAACCGACATGCTGGGAGATTACATCTTCTC
TATGGCAAGCGTGACTTCTTGCTGAGTGACAAAGCCTCTAGCCTCCTCTGCTTCCAGCACCAGGAGGAGAGCCTG
GCTCAGGGCCCCCCGCTGTTAGCCACTTCTGTCACCTCCTGGTGGAGCCCTCAGAACATCAGCCTGCCCAGTGCC
GCCAGCTTCACCTTCTCCTTCCACAGTCCTCCCCACACGGCCGCTCACAATGCCTCGGTGGACATGTGCGAGCTC
AAAAGGGACCTCCAGCTGCTCAGCCAGTTCCTGAAGCATCCCCAGAAGGCCTCAAGGAGGCCCTCGGCTGCCCCC
GCCAGCCAGCAGTTGCAGAGCCTGGAGTCGAAACTGACCTCTGTGAGATTCATGGGGGACATGGTGTCCTTCGAG
GAGGACCGGATCAACGCCACGGTGTGGAAGCTCCAGCCCACAGCCGGCCTCCAGGACCTGCACATCCACTCCCGG
CAGGAGGAGGAGCAGAGCGAGATCATGGAGTACTCGGTGCTGCTGCCTCGAACACTCTTCCAGAGGACGAAAGGC
CGGAGCGGGGAGGCTGAGAAGAGACTCCTCCTGGTGGACTTCAGCAGCCAAGCCCTGTTCCAGGACAAGAATTCC
AGCCAAGTCCTGGGTGAGAAGGTCTTGGGGATTGTGGTACAGAACACCAAAGTAGCCAACCTCACGGAGCCCGTG
GTGCTCACTTTCCAGCACCAGCTACAGCCGAAGAATGTGACTCTGCAATGTGTGTTCTGGGTTGAAGACCCCACA
TTGAGCAGCCCGGGGCATTGGAGCAGTGCTGGGTGTGAGACCGTCAGGAGAGAAACCCAAACATCCTGCTTCTGC
AACCACTTGACCTACTTTGCAGTGCTGATGGTCTCCTCGGTGGAGGTGGACGCCGTGCACAAGCACTACCTGAGC
CTCCTCTCCTACGTGGGCTGTGTCGTCTCTGCCCTGGCCTGCCTTGTCACCATTGCCGCCTACCTCTGCTCCAGG
GTGCCCCTGCCGTGCAGGAGGAAACCTCGGGACTACACCATCAAGGTGCACATGAACCTGCTGCTGGCCGTCTTC
CTGCTGGACACGAGCTTCCTGCTCAGCGAGCCGGTGGCCCTGACAGGCTCTGAGGCTGGCTGCCGAGCCAGTGCC
ATCTTCCTGCACTTCTCCCTGCTCACCTGCCTTTCCTGGATGGGCCTCGAGGGGTACAACCTCTACCGACTCGTG
GTGGAGGTCTTTGGCACCTATGTCCCTGGCTACCTACTCAAGCTGAGCGCCATGGGCTGGGGCTTCCCCATCTTT
CTGGTGACGCTGGTGGCCCTGGTGGATGTGGACAACTATGGCCCCATCATCTTGGCTGTGCATAGGACTCCAGAG
GGCGTCATCTACCCTTCCATGTGCTGGATCCGGGACTCCCTGGTCAGCTACATCACCAACCTGGGCCTCTTCAGC
CTGGTGTTTCTGTTCAACATGGCCATGCTAGCCACCATGGTGGTGCAGATCCTGCGGCTGCGCCCCACACCCAA
AAGTGGTCACATGTGCTGACACTGCTGGGCCTCAGCCTGGTCCTTGGCCTGCCCTGGGCCTTGATCTTCTTCTCC
TTTGCTTCTGGCACCTTCCAGCTTGTCGTCCTCTACCTTTTCAGCATCATCACCTCCTTCCAAGGCTTCCTCATC
TTCATCTGGTACTGGTCCATGCGGCTGCAGGCCCGGGTGGCCCCTCCCCTCTGAAGAGCAACTCAGACAGCGCC
AGGCTCCCCATCAGCTCGGGCAGCACCTCGTCCAGCCGCATCTAGGCCTCCAGCCCACCTGCCCATGTGATGAAG
CAGAGATGCGGCCTCGTCGCACACTGCCTGTGGCCCCCGAGCCAGGCCCAGCCCCAGGCCAGTCAGCCGCAGACT
TTGGAAAGCCCAACGACCATGGAGAGATGGGCCGTTGCCATGGTGGACGGACTCCCGGGCTGGGCTTTTGAATTG
GCCTTGGGGACTACTCGGCTCTCACTCAGCTCCCACGGGACTCAGAAGTGCGCGCCATGCTGCCTAGGGTACTG
TCCCCACATCTGTCCCAACCCAGCTGGAGGCCTGGTCTCTCCTTACAACCCCTGGGCCCAGCCCTCATTGCTGGG
GGCCAGGCCTTGGATCTTGAGGGTCTGGCACATCCTTAATCCTGTGCCCCTGCCTGGGACAGAAATGTGGCTCCA
GTTGCTCTGTCTCTCGTGGTCACCCTGAGGGCACTCTGCATCCTCTGTCATTTTAACCTCAGGTGGCACCCAGGG
CGAATGGGCCCAGGGCAGACCTTCAGGGCCAGAGCCCTGGCGGAGGAGAGGCCCTTTGCCAGGAGCACAGCAGC
AGCTCGCCTACCTCTGAGCCCAGGCCCCCTCCCTCCCTCAGCCCCCCAGTCCTCCCTCCATCTTCCCTGGGGTTC
TCCTCCTCTCCCAGGGCCTCCTTGCTCCTTCGTTCACAGCTGGGGGTCCCCGATTCCAATGCTGTTTTTTGGGGA
GTGGTTTCCAGGAGCTGCCTGGTGTCTGCTGTAAATGTTTGTCTACTGCACAAGCCTCGGCCTGCCCCTGAGCCA
GGCTCGGTACCGATGCGTGGGCTGGGCTAGGTCCCTCTGTCCATCTGGGCCTTTGTATGAGCTGCATTGCCCTTG
CTCACCCTGACCAAGCACACGCCTCAGAGGGGCCCTCAGCCTCTCCTGAAGCCCTCTTGTGGCAAGAACTGTGGA
CCATGCCAGTCCCGTCTGGTTTCCATCCCACCACTCCAAGGACTGAGACTGACCTCCTCTGGTGACACTGGCCTA
GAGCCTGACACTCTCCTAAGAGGTTCTCTCCAAGCCCCCAAATAGCTCCAGGCGCCCTCGGCCGCCCATCATGGT
TAATTCTGTCCAACAAACACACGGGTAGATTGCTGGCCTGTTGTAGGTGGTAGGGACACAGATGACCGACCTG
GTCACTCCTCCTGCCAACATTCAGTCTGGTATGTGAGGCGTGCGTGAAGCAAGAACTCCTGGAGCTACAGGGACA
GGGAGCCATCATTCCTGCCTGGGAATCCTGGAAGACTTCCTGCAGGAGTCAGCGTTCAATCTTGACCTTGAAGAT
GGGAAGGATGTTCTTTTTACGTACCAATTCTTTTGTCTTTTGATATTAAAAGAAGTACATGTTCATTGTAGAGA
ATTTGGAAACTGTAGAAGAGAATCAAGAAGAAAAATAAAAATCAGCTGTTGTAATCGCCTAGCAAAAAAAAAAAA
AAAAAAAAAAAAAAAAAAAAAAAAAAAAAAAAAAAAAAAAAAAAAAAAAAAAAAAAAAAAAAAAAAAAAAAAAA
```

FIGURE 204

</usr/seqdb2/sst/DNA/Dnaseqs.min/ss.DNA50921
<subunit 1 of 1, 693 aa, 1 stop
<MW: 77738, pI: 8.87, NX(S/T): 7

MTPQSLLQTTLFLLSLLFLVQGAHGRGHREDFRFCSQRNQTHRSSLHYKPTPDLRISIENSE
EALTVHAPFPAAHPASRSFPDPRGLYHFCLYWNRHAGRLHLLYGKRDFLLSDKASSLLCFQH
QEESLAQGPPLLATSVTSWWSPQNISLPSAASFTFSFHSPPHTAAHNASVDMCELKRDLQLL
SQFLKHPQKASRRPSAAPASQQLQSLESKLTSVRFMGDMVSFEEDRINATVWKLQPTAGLQD
LHIHSRQEEEQSEIMEYSVLLPRTLFQRTKGRSGEAEKRLLLVDFSSQALFQDKNSSQVLGE
KVLGIVVQNTKVANLTEPVVLTFQHQLQPKNVTLQCVFWVEDPTLSSPGHWSSAGCETVRRE
TQTSCFCNHLTYFAVLMVSSVEVDAVHKHYLSLLSYVGCVVSALACLVTIAAYLCSRVPLPC
RRKPRDYTIKVHMNLLLAVFLLDTSFLLSEPVALTGSEAGCRASAIFLHFSLLTCLSWMGLE
GYNLYRLVVEVFGTYVPGYLLKLSAMGWGFPIFLVTLVALVDVDNYGPIILAVHRTPEGVIY
PSMCWIRDSLVSYITNLGLFSLVFLFNMAMLATMVVQILRLRPHTQKWSHVLTLLGLSLVLG
LPWALIFFSFASGTFQLVVLYLFSIITSFQGFLIFIWYWSMRLQARGGPSPLKSNSDSARLP
ISSGSTSSSRI

Important features:
Signal peptide:
amino acids 1-25
Putative transmembrane domains:
amino acids 382-398, 402-420, 445-468, 473-491, 519-537, 568-590
and 634-657
Microbodies C-terminal targeting signal.
amino acids 691-693
cAMP- and cGMP-dependent protein kinase phosphorylation sites.
amino acids 198-201 and 370-373
N-glycosylation sites.
amino acids 39-42, 148-151, 171-174, 234-237, 303-306, 324-327
and 341-344
G-protein coupled receptors family 2 proteins
amino acids 475-504

FIGURE 205

TGCCTGGCCTGCCTTGTCAACAATGCCGCTTACTCTGCTTCCAGGTTGCCCTGCCTTGCAGA
GGAAANCNTCGGGACTACACCNTCAAGTGCACATGAACCTGCTGCTGGCCGTCTTCCTGCTG
GACACGAGCTTCCTGCTCAGCGNAGCCGGTGGCCCTGACAGGCTCTGAAGGCTGGCTGCCGA
GCCAGTGCCATCTTCCTGCACTTCTCCTGCTCACCTGCCTTTCCTGGATGGGCCTCGAGGGG
TACAACCTCTACCGACTCGTGGTGGAGGTCTTTGGCACCTATGTCCCTGGCTACCTACTCAA
GCTGAGCGCCATGGGCTGGGGCTTCCCCATCTTTCTGGTGACGCTGGTGGCCCTGGTGGATG
TGGACAACTATGGCCCCATCATCTTGGCTGTGCATAGGACTCCAGAGGGCGTCATCTACCCT
TCCATGTGCTGGATCCGGGACTCCCTGGTCAGCTACATCACCAACCTGGGCCTCTTCAGCCT
GGTGTTTCTGTTCAACATGG

FIGURE 206

```
CGGACGCGTGGGCGGACGCGTGGGCGGACGCGTGGGCTGGTTCAGGTCCAGGTTTTGCTTTGA
TCCTTTTCAAAAACTGGAGACACAGAAGAGGGCTCTAGGAAAAAGTTTTGGATGGGATTATGTGGAAACTACCCT
GCGATTCTCTGCTGCCAGAGCAGGCTCGGCGCTTCCACCCCAGTGCAGCCTTCCCCTGGCGGTGGTGAAAGAGAC
TCGGGAGTCGCTGCTTCCAAAGTGCCCGCCGTGAGTGAGCTCTCACCCCAGTCAGCCAAATGAGCCTCTTCGGGC
TTCTCCTGCTGACATCTGCCCTGGCCGGCCAGAGACAGGGGACTCAGGCGGAATCCAACCTGAGTAGTAAATTCC
AGTTTTCCAGCAACAAGGAACAGAACGGAGTACAAGATCCTCAGCATGAGAGAATTATTACTGTGTCTACTAATG
GAAGTATTCACAGCCCAAGGTTTCCTCATACTTATCCAAGAAATACGGTCTTGGTATGGAGATTAGTAGCAGTAG
AGGAAAATGTATGGATACAACTTACGTTTGATGAAAGATTTGGGCTTGAAGACCCAGAAGATGACATATGCAAGT
ATGATTTTGTAGAAGTTGAGGAACCCAGTGATGGAACTATATTAGGGCGCTGGTGTGGTTCTGGTACTGTACCAG
GAAAACAGATTTCTAAAGGAAATCAAATTAGGATAAGATTTGTATCTGATGAATATTTTCCTTCTGAACCAGGGT
TCTGCATCCACTACAACATTGTCATGCCACAATTCACAGAAGCTGTGAGTCCTTCAGTGCTACCCCTTCAGCTT
TGCCACTGGACCTGCTTAATAATGCTATAACTGCCTTTAGTACCTTGGAAGACCTTATTCGATATCTTGAACCAG
AGAGATGGCAGTTGGACTTAGAAGATCTATATAGGCCAACTTGGCAACTTCTTGGCAAGGCTTTTGTTTTTGGAA
GAAAATCCAGAGTGGTGGATCTGAACCTTCTAACAGAGGAGGTAAGATTATACAGCTGCACACCTCGTAACTTCT
CAGTGTCCATAAGGGAAGAACTAAAGAGAACCGATACCATTTTCTGGCCAGGTTGTCTCCTGGTTAAACGCTGTG
GTGGGAACTGTGCCTGTTGTCTCCACAATTGCAATGAATGTCAATGTGTCCCAAGCAAAGTTACTAAAAAATACC
ACGAGGTCCTTCAGTTGAGACCAAAGACCGGTGTCAGGGGATTGCACAAATCACTCACCGACGTGGCCCTGGAGC
ACCATGAGGAGTGTGACTGTGTGTGCAGAGGGAGCACAGGAGGATAGCCGCATCACCACCAGCAGCTCTTGCCCA
GAGCTGTGCAGTGCAGTGGCTGATTCTATTAGAGAACGTATGCGTTATCTCCATCCTTAATCTCAGTTGTTTGCT
TCAAGGACCTTTCATCTTCAGGATTTACAGTGCATTCTGAAAGAGGAGACATCAAACAGAATTAGGAGTTGTGCA
ACAGCTCTTTTGAGAGGAGGCCTAAAGGACAGGAGAAAAGGTCTTCAATCGTGGAAAGAAAATTAAATGTTGTAT
TAAATAGATCACCAGCTAGTTTCAGAGTTACCATGTACGTATTCCACTAGCTGGGTTCTGTATTTCAGTTCTTTC
GATACGGCTTAGGGTAATGTCAGTACAGGAAAAAAACTGTGCAAGTGAGCACCTGATTCCGTTGCCTTGCTTAAC
TCTAAAGCTCCATGTCCTGGGCCTAAAATCGTATAAAATCTGGATTTTTTTTTTTTTTTGCTCATATTCACAT
ATGTAAACCAGAACATTCTATGTACTACAAACCTGGTTTTTAAAAAGGAACTATGTTGCTATGAATTAAACTTGT
GTCATGCTGATAGGACAGACTGGATTTTTCATATTTCTTATTAAAATTTCTGCCATTTAGAAGAAGAGAACTACA
TTCATGGTTTGGAAGAGATAAACCTGAAAAGAAGAGTGGCCTTATCTTCACTTTATCGATAAGTCAGTTTATTTG
TTTCATTGTGTACATTTTTATATTCTCCTTTTGACATTATAACTGTTGGCTTTTCTAATCTTGTTAAATATATCT
ATTTTTACCAAAGGTATTTAATATTCTTTTTTATGACAACTTAGATCAACTATTTTTAGCTTGGTAAATTTTTCT
AAACACAATTGTTATAGCCAGAGGAACAAAGATGATATAAAATATTGTTGCTCTGACAAAAATACATGTATTTCA
TTCTCGTATGGTGCTAGAGTTAGATTAATCTGCATTTTAAAAAACTGAATTGGAATAGAATTGGTAAGTTGCAAA
GACTTTTTGAAAATAATTAAATTATCATATCTTCCATTCCTGTTATTGGAGATGAAAATAAAAAGCAACTTATGA
AAGTAGACATTCAGATCCAGCCATTACTAACCTATTCCTTTTTGGGGAAATCTGAGCCTAGCTCAGAAAAACAT
AAAGCACCTTGAAAAAGACTTGGCAGCTTCCTGATAAAGCGTGCTGTGCTGTGCAGTAGGAACACATCCTATTTA
TTGTGATGTTGTGGTTTTATTATCTTAAACTCTGTTCCATACACTTGTATAAATACATGGATATTTTATGTACA
GAAGTATGTCTCTTAACCAGTTCACTTATTGTACTCTGGCAATTTAAAAGAAAATCAGTAAAATATTTTGCTTGT
AAAATGCTTAATATNGTGCCTAGGTTATGTGGTGACTATTTGAATCAAAATGTATTGAATCATCAAATAAAAGA
ATGTGGCTATTTTGGGGAGAAAATTAAAAAAAAAAAAAAAAAAAGGTTTAGGGATAACAGGGTAATGCGGCC
```

FIGURE 207

MSLFGLLLLTSALAGQRQGTQAESNLSSKFQFSSNKEQNGVQDPQHERIITVSTNGSIHSPR
FPHTYPRNTVLVWRLVAVEENVWIQLTFDERFGLEDPEDDICKYDFVEVEEPSDGTILGRWC
GSGTVPGKQISKGNQIRIRFVSDEYFPSEPGFCIHYNIVMPQFTEAVSPSVLPPSALPLDLL
NNAITAFSTLEDLIRYLEPERWQLDLEDLYRPTWQLLGKAFVFGRKSRVVDLNLLTEEVRLY
SCTPRNFSVSIREELKRTDTIFWPGCLLVKRCGGNCACCLHNCNECQCVPSKVTKKYHEVLQ
LRPKTGVRGLHKSLTDVALEHHEECDCVCRGSTGG

Signal sequence:
amino acids 1-14

FIGURE 208

```
CCCATCTCAAGCTGATCTTGGCACCTCTCATGCTCTGCTCTCTTCAACCAGACCTCTACATTCCATTTTGGAAGA
AGACTAAAAATGGTGTTTCCAATGTGGACACTGAAGAGACAAATTCTTATCCTTTTTAACATAATCCTAATTTCC
AAACTCCTTGGGGCTAGATGGTTTCCTAAAACTCTGCCCTGTGATGTCACTCTGGATGTTCCAAAGAACCATGTG
ATCGTGGACTGCACAGACAAGCATTTGACAGAAATTCCTGGAGGTATTCCCACGAACACCACGAACCTCACCCTC
ACCATTAACCACATACCAGACATCTCCCCAGCGTCCTTTCACAGACTGGACCATCTGGTAGAGATCGATTTCAGA
TGCAACTGTGTACCTATTCCACTGGGGTCAAAAAACAACATGTGCATCAAGAGGCTGCAGATTAAACCCAGAAGC
TTTAGTGGACTCACTTATTTAAAATCCCTTTACCTGGATGGAAACCAGCTACTAGAGATACCGCAGGGCCTCCCG
CCTAGCTTACAGCTTCTCAGCCTTGAGGCCAACAACATCTTTTCCATCAGAAAAGAGAATCTAACAGAACTGGCC
AACATAGAAATACTCTACCTGGGCCAAAACTGTTATTATCGAAATCCTTGTTATGTTTCATATTCAATAGAGAAA
GATGCCTTCCTAAACTTGACAAAGTTAAAAGTGCTCTCCCTGAAAGATAACAATGTCACAGCCGTCCCTACTGTT
TTGCCATCTACTTTAACAGAACTATATCTCTACAACAACATGATTGCAAAAATCCAAGAAGATGATTTTAATAAC
CTCAACCAATTACAAATTCTTGACCTAAGTGGAAATTGCCCTCGTTGTTATAATGCCCCATTTCCTTGTGCGCCG
TGTAAAAATAATTCTCCCCTACAGATCCCTGTAAATGCTTTTGATGCGCTGACAGAATTAAAAGTTTTACGTCTA
CACAGTAACTCTCTTCAGCATGTGCCCCAAGATGGTTTAAGAACATCAACAAACTCCAGGAACTGGATCTGTCC
CAAAACTTCTTGGCCAAAGAAATTGGGGATGCTAAATTTCTGCATTTTCTCCCCAGCCTCATCCAATTGGATCTG
TCTTTCAATTTTGAACTTCAGGTCTATCGTGCATCTATGAATCTATCACAAGCATTTTCTTCACTGAAAAGCCTG
AAAATTCTGCGGATCAGAGGATATGTCTTTAAAGAGTTGAAAAGCTTTAACCTCTCGCCATTACATAATCTTCAA
AATCTTGAAGTTCTTGATCTTGGCACTAACTTTATAAAAATTGCTAACCTCAGCATGTTTAAACAATTTAAAAGA
CTGAAAGTCATAGATCTTTCAGTGAATAAAATATCACCTTCAGGAGATTCAAGTGAAGTTGGCTTCTGCTCAAAT
GCCAGAACTTCTGTAGAAAGTTATGAACCCCAGGTCCTGGAACAATTACATTATTTCAGATATGATAAGTATGCA
AGGAGTTGCAGATTCAAAAACAAAGAGGCTTCTTTCATGTCTGTTAATGAAAGCTGCTACAAGTATGGGCAGACC
TTGGATCTAAGTAAAAATAGTATATTTTTTGTCAAGTCCTCTGATTTTCAGCATCTTTCTTTCCTCAAATGCCTG
AATCTGTCAGGAAATCTCATTAGCCAAACTCTTAATGGCAGTGAATTCCAACCTTTAGCAGAGCTGAGATATTTG
GACTTCTCCAACAACCGGCTTGATTTACTCCATTCAACAGCATTTGAAGAGCTTCACAAACTGGAAGTTCTGGAT
ATAAGCAGTAATAGCCATTATTTTCAATCAGAAGGAATTACTCATATGCTAAACTTTACCAAGAACCTAAAGGTT
CTGCAGAAACTGATGATGAACGACAATGACATCTCTTCCTCCACCAGCAGGACCATGGAGAGTGAGTCTCTTAGA
ACTCTGGAATTCAGAGGAAATCACTTAGATGTTTATGGAGAGAAGGTGATAACAGATACTTACAATTATTCAAG
AATCTGCTAAAATTAGAGGAATTAGACATCTCTAAAAATTCCCTAAGTTTCTTGCCTTCTGGAGTTTTTGATGGT
ATGCCTCCAAATCTAAAGAATCTCTCTTTGGCCAAAAATGGGCTCAAATCTTTCAGTTGGAAGAAACTCCAGTGT
CTAAAGAACCTGGAAACTTTGGACCTCAGCCACAACCAACTGACCACTGTCCCTGAGAGATTATCCAACTGTTCC
AGAAGCCTCAAGAATCTGATTCTTAAGAATAATCAAATCAGGAGTCTGACGAAGTATTTTCTACAAGATGCCTTC
CAGTTGCGATATCTGGATCTCAGCTCAAATAAAATCCAGATGATCCAAAAGACCAGCTTCCCAGAAAATGTCCTC
AACAATCTGAAGATGTTGCTTTTGCATCATAATCGGTTTCTGTGCACCTGTGATGCTGTGTGGTTTGTCTGGTGG
GTTAACCATACGGAGGTGACTATTCCTTACCTGGCCACAGATGTGACTTGTGTGGGCCAGGAGCACACAAGGGC
CAAAGTGTGATCTCCCTGGATCTGTACACCTGTGAGTTAGATCTGACTAACCTGATTCTGTTCTCACTTTCCATA
TCTGTATCTCTCTTTCTCATGGTGATGATGACAGCAAGTCACCTCTATTTCTGGGATGTGTGGTATATTTACCAT
TTCTGTAAGGCCAAGATAAAGGGGTATCAGCGTCTAATATCACCAGACTGTTGCTATGATGCTTTTATTGTGTAT
GACACTAAAGACCCAGCTGTGACCGAGTGGGTTTTGGCTGAGCTGGTGGCCAAACTGGAAGACCCAAGAGAGAAA
CATTTTAATTTATGTCTCGAGGAAAGGGACTGGTTACCAGGGCAGCCAGTTCTGGAAAACCTTTCCCAGAGCATA
CAGCTTAGCAAAAAGACAGTGTTTGTGATGACAGACAAGTATGCAAAGACTGAAAATTTTAAGATAGCATTTTAC
TTGTCCCATCAGAGGCTCATGGATGAAAAAGTTGATGTGATTATCTTGATATTTCTTGAAGCCCTTTCAGAAG
TCCAAGTTCCTCCAGCTCCGGAAAAGGCTCTGTGGGAGTTCTGTCCTTGAGTGGCCAACAAACCCGCAAGCTCAC
CCATACTTCTGGCAGTGTCTAAAGAACGCCCTGGCCACAGACAATCATGTGGCCTATAGTCAGGTGTTCAAGGAA
ACGGTCTAGCCCTTCTTTGCAAAACACAACTGCCTAGTTTACCAAGGAGAGGCCTGGC
```

FIGURE 209

MVFPMWTLKRQILILFNIILISKLLGARWFPKTLPCDVTLDVPKNHVIVDCTDKHLTEIPGG
IPTNTTNLTLTINHIPDISPASFHRLDHLVEIDFRCNCVPIPLGSKNNMCIKRLQIKPRSFS
GLTYLKSLYLDGNQLLEIPQGLPPSLQLLSLEANNIFSIRKENLTELANIEILYLGQNCYYR
NPCYVSYSIEKDAFLNLTKLKVLSLKDNNVTAVPTVLPSTLTELYLYNNMIAKIQEDDFNNL
NQLQILDLSGNCPRCYNAPFPCAPCKNNSPLQIPVNAFDALTELKVLRLHSNSLQHVPPRWF
KNINKLQELDLSQNFLAKEIGDAKFLHFLPSLIQLDLSFNFELQVYRASMNLSQAFSSLKSL
KILRIRGYVFKELKSFNLSPLHNLQNLEVLDLGTNFIKIANLSMFKQFKRLKVIDLSVNKIS
PSGDSSEVGFCSNARTSVESYEPQVLEQLHYFRYDKYARSCRFKNKEASFMSVNESCYKYGQ
TLDLSKNSIFFVKSSDFQHLSFLKCLNLSGNLISQTLNGSEFQPLAELRYLDFSNNRLDLLH
STAFEELHKLEVLDISSNSHYFQSEGITHMLNFTKNLKVLQKLMMNDNDISSSTSRTMESES
LRTLEFRGNHLDVLWREGDNRYLQLFKNLLKLEELDISKNSLSFLPSGVFDGMPPNLKNLSL
AKNGLKSFSWKKLQCLKNLETLDLSHNQLTTVPERLSNCSRSLKNLILKNNQIRSLTKYFLQ
DAFQLRYLDLSSNKIQMIQKTSFPENVLNNLKMLLLHHNRFLCTCDAVWFVWWVNHTEVTIP
YLATDVTCVGPGAHKGQSVISLDLYTCELDLTNLILFSLSISVSLFLMVMMTASHLYFWDVW
YIYHFCKAKIKGYQRLISPDCCYDAFIVYDTKDPAVTEWVLAELVAKLEDPREKHFNLCLEE
RDWLPGQPVLENLSQSIQLSKKTVFVMTDKYAKTENFKIAFYLSHQRLMDEKVDVIILIFLE
KPFQKSKFLQLRKRLCGSSVLEWPTNPQAHPYFWQCLKNALATDNHVAYSQVFKETV

Signal sequence:
amino acids 1-26

Transmembrane domain:
amino acids 840-860

FIGURE 210

```
GGGTACCATTCTGCGCTGCTGCAAGTTACGGAATGAAAAATTAGAACAACAGAAACATGGAAAACATGTTCCTTC
AGTCGTCAATGCTGACCTGCATTTTCCTGCTAATATCTGGTTCCTGTGAGTTATGCGCCGAAGAAAATTTTTCTA
GAAGCTATCCTTGTGATGAGAAAAAGCAAATGACTCAGTTATTGCAGAGTGCAGCAATCGTCGACTACAGGAAG
TTCCCCAAACGGTGGGCAAATATGTGACAGAACTAGACCTGTCTGATAATTTCATCACACACATAACGAATGAAT
CATTTCAAGGGCTGCAAAATCTCACTAAAATAAATCTAAACCACAACCCCAATGTACAGCACCAGAACGGAAATC
CCGGTATACAATCAAATGGCTTGAATATCACAGACGGGGCATTCCTCAACCTAAAAAACCTAAGGGAGTTACTGC
TTGAAGACAACCAGTTACCCCAAATACCCTCTGGTTTGCCAGAGTCTTTGACAGAACTTAGTCTAATTCAAAACA
ATATATACAACATAACTAAAGAGGGCATTTCAAGACTTATAAACTTGAAAAATCTCTATTTGGCCTGGAACTGCT
ATTTTAACAAAGTTTGCGAGAAAACTAACATAGAAGATGGAGTATTTGAAACGCTGACAAATTTGGAGTTGCTAT
CACTATCTTTCAATTCTCTTTCACACGTGCCACCCAAACTGCCAAGCTCCCTACGCAAACTTTTTCTGAGCAACA
CCCAGATCAAATACATTAGTGAAGAAGATTTCAAGGGATTGATAAATTTAACATTACTAGATTTAAGCGGGAACT
GTCCGAGGTGCTTCAATGCCCCATTTCCATGCGTGCCTTGTGATGGTGGTGCTTCAATTAATATAGATCGTTTTG
CTTTTCAAAACTTGACCCAACTTCGATACCTAAACCTCTCTAGCACTTCCCTCAGGAAGATTAATGCTGCCTGGT
TTAAAAATATGCCTCATCTGAAGGTGCTGGATCTTGAATTCAACTATTTAGTGGGAGAAATAGTCTCTGGGGCAT
TTTTAACGATGCTGCCCCGCTTAGAAATACTTGACTTGTCTTTTAACTATATAAAGGGGAGTTATCCACAGCATA
TTAATATTTCCAGAAACTTCTCTAAACTTTTGTCTCTACGGGCATTGCATTTAAGAGGTTATGTGTTCCAGGAAC
TCAGAGAAGATGATTTCCAGCCCCTGATGCAGCTTCCAAACTTATCGACTATCAACTTGGGTATTAATTTTATTA
AGCAAATCGATTTCAAACTTTTCCAAAATTTCTCCAATCTGGAAATTATTTACTTGTCAGAAAACAGAATATCAC
CGTTGGTAAAAGATACCCGGCAGAGTTATGCAAATAGTTCCTCTTTTCAACGTCATATCCGGAAACGACGCTCAA
CAGATTTTGAGTTTGACCCACATTCGAACTTTTATCATTTCACCCGTCCTTTAATAAAGCCACAATGTGCTGCTT
ATGGAAAAGCCTTAGATTTAAGCCTCAACAGTATTTTCTTCATTGGGCCAAACCAATTTGAAAATCTTCCTGACA
TTGCCTGTTTAAATCTGTCTGCAAATAGCAATGCTCAAGTGTTAAGTGGAACTGAATTTTCAGCCATTCCTCATG
TCAAATATTTGGATTTGACAAACAATAGACTAGACTTTGATAATGCTAGTGCTCTTACTGAATTGTCCGACTTGG
AAGTTCTAGATCTCAGCTATAATTCACACTATTTCAGAATAGCAGGCGTAACACATCATCTAGAATTTATTCAAA
ATTTCACAAATCTAAAAGTTTTAAACTTGAGCCACAACAACATTTATACTTTAACAGATAAGTATAACCTGGAAA
GCAAGTCCCTGGTAGAATTAGTTTTCAGTGGCAATCGCTTGACATTTTGTGGAATGATGATGACAACAGGTATA
TCTCCATTTTCAAAGGTCTCAAGAATCTGACACGTCTGGATTTATCCCTTAATAGGCTGAAGCACATCCCAAATG
AAGCATTCCTTAATTTGCCAGCGAGTCTCACTGAACTACATATAAATGATAATATGTTAAAGTTTTTTAACTGGA
CATTACTCCAGCAGTTTCCTCGTCTCGAGTTGCTTGACTTACGTGGAAACAAACTACTCTTTTTAACTGATAGCC
TATCTGACTTTACATCTTCCCTTCGGACACTGCTGCTGAGTCATAACAGGATTTCCCACCTACCCTCTGGCTTTC
TTTCTGAAGTCAGTAGTCTGAAGCACCTCGATTTAAGTTCCAATCTGCTAAAACAATCAACAAATCCGCACTTG
AAACTAAGACCACCACCAAATTATCTATGTTGGAACTACACGGAAACCCCTTTGAATGCACCTGTGACATTGGAG
ATTTCCGAAGATGGATGGATGAACATCTGAATGTCAAAATTCCCAGACTGGTAGATGTCATTTGTGCCAGTCCTG
GGGATCAAAGAGGGAAGAGTATTGTGAGTCTGGAGCTAACAACTTGTGTTTCAGATGTCACTGCAGTGATATTAT
TTTTCTTCACGTTCTTTATCACCACCATGGTTATGTTGGCTGCCCTGGCTCACCATTTGTTTTACTGGGATGTTT
GGTTTATATATAATGTGTGTTTAGCTAAGGTAAAAGGCTACAGGTCTCTTTCCACATCCCAAACTTTCTATGATG
CTTACATTTCTTATGACACCAAAGATGCCTCTGTTACTGACTGGGTGATAAATGAGCTGCGCTACCACCTTGAAG
AGAGCCGAGACAAAAACGTTCTCCTTTGTCTAGAGGAGAGGGATTGGGACCCGGGATTGGCCATCATCGACAACC
TCATGCAGAGCATCAACCAAAGCAAGAAAACAGTATTTGTTTTAACCAAAAAATATGCAAAAAGCTGGAACTTTA
AAACAGCTTTTTACTTGGCTTTGCAGAGGCTAATGGATGAGAACATGGATGTGATTATATTTATCCTGCTGGAGC
CAGTGTTACAGCATTCTCAGTATTTGAGGCTACGGCAGCGGATCTGTAAGAGCTCCATCCTCCAGTGGCCTGACA
ACCCGAAGGCAGAAGGCTTGTTTTGGCAAACTCTGAGAAATGTGGTCTTGACTGAAAATGATTCACGGTATAACA
ATATGTATGTCGATTCCATTAAGCAATACTAACTGACGTTAAGTCATGATTTCGCGCCATAATAAAGATGCAAAG
GAATGACATTTCTGTATTAGTTATCTATTGCTATGTAACAAATTATCCCAAAACTTAGTGGTTTAAAACAACACA
TTTGCTGGCCCACAGTTTTTGAGGGTCAGGAGTCCAGGCCCAGCATAACTGGGTCCTCTGCTCAGGGTGTCTCAG
AGGCTGCAATGTAGGTGTTCACCAGAGACATAGGCATCACTGGGGTCACACTCATGTGGTTGTTTCTGGATTCA
ATTCCTCCTGGGCTATTGGCCAAAGGCTATACTCATGTAAGCCATGCGAGCCTCTCCCACAAGGCAGCTTGCTTC
ATCAGAGCTAGCAAAAAGAGAGGTTGCTAGCAAGATGAAGTCACAATCTTTTGTAATCGAATCAAAAAGTGAT
ATCTCATCACTTTGGCCATATTCTATTTGTTAGAAGTAAACCACAGGTCCCACCAGCTCCATGGGAGTGACCACC
TCAGTCCAGGGAAAACAGCTGAAGACCAAGATGGTGAGCTCTGATTGCTTCAGTTGGTCATCAACTATTTTCCCT
TGACTGCTGTCCTGGGATGGCCTGCTATCTTGATGATAGATTGTGAATATCAGGAGGCAGGGATCACTGTGGACC
ATCTTAGCAGTTGACCTAACACATCTTCTTTTCAATATCTAAGAACTTTTGCCACTGTGACTAATGGTCCTAATA
TTAAGCTGTTGTTTATATTTATCATATATCTATGGCTACATGGTTATATTATGTCGTGGTTGCGTTCGGTTTTAT
TTACAGTTGCTTTTACAAATATTTGCTGTAACATTTGACTTCTAAGGTTTAGGTGCCATTTAAGAACTGAGATGG
ATAGCTTTTAAAGCATCTTTTACTTCTTACCATTTTTTAAAAGTATGCAGCTAAATTCGAAGCTTTTGGTCTATA
TTGTTAATTGCCATTGCTGTAAATCTTAAAATGAATGAATAAAAATGTTTCATTTTACAAAAAAAAAAAAAAAA
```

FIGURE 211

MENMFLQSSMLTCIFLLISGSCELCAEENFSRSYPCDEKKQNDSVIAECSNRRLQEVPQTVG
KYVTELDLSDNFITHITNESFQGLQNLTKINLNHNPNVQHQNGNPGIQSNGLNITDGAFLNL
KNLRELLLEDNQLPQIPSGLPESLTELSLIQNNIYNITKEGISRLINLKNLYLAWNCYFNKV
CEKTNIEDGVFETLTNLELLSLSFNSLSHVPPKLPSSLRKLFLSNTQIKYISEEDFKGLINL
TLLDLSGNCPRCFNAPFPCVPCDGGASINIDRFAFQNLTQLRYLNLSSTSLRKINAAWFKNM
PHLKVLDLEFNYLVGEIVSGAFLTMLPRLEILDLSFNYIKGSYPQHINISRNFSKLLSLRAL
HLRGYVFQELREDDFQPLMQLPNLSTINLGINFIKQIDFKLFQNFSNLEIIYLSENRISPLV
KDTRQSYANSSSFQRHIRKRRSTDFEFDPHSNFYHFTRPLIKPQCAAYGKALDLSLNSIFFI
GPNQFENLPDIACLNLSANSNAQVLSGTEFSAIPHVKYLDLTNNRLDFDNASALTELSDLEV
LDLSYNSHYFRIAGVTHHLEFIQNFTNLKVLNLSHNNIYTLTDKYNLESKSLVELVFSGNRL
DILWNDDDNRYISIFKGLKNLTRLDLSLNRLKHIPNEAFLNLPASLTELHINDNMLKFFNWT
LLQQFPRLELLDLRGNKLLFLTDSLSDFTSSLRTLLLSHNRISHLPSGFLSEVSSLKHLDLS
SNLLKTINKSALETKTTTKLSMLELHGNPFECTCDIGDFRRWMDEHLNVKIPRLVDVICASP
GDQRGKSIVSLELTTCVSDVTAVILFFFTFFITTMVMLAALAHHLFYWDVWFIYNVCLAKVK
GYRSLSTSQTFYDAYISYDTKDASVTDWVINELRYHLEESRDKNVLLCLEERDWDPGLAIID
NLMQSINQSKKTVFVLTKKYAKSWNFKTAFYLALQRLMDENMDVIIFILLEPVLQHSQYLRL
RQRICKSSILQWPDNPKAEGLFWQTLRNVVLTENDSRYNNMYVDSIKQY

Signal sequence:
amino acids 1-26

Transmembrane domain:
amino acids 826-848

FIGURE 212

CCAGGTCCAACTGCACCTCGGTTCTATCGATTGAATTCCCCGGGGATCCTCTAGAGATCCCT
CGACCTCGACCCACGCGTCCGCCAAGCTGGCCCTGCACGGCTGCAAGGGAGGCTCCTGTGGA
CAGGCCAGGCAGGTGGGCCTCAGGAGGTGCCTCCAGGCGGCCAGTGGGCCTGAGGCCCCAGC
AAGGGCTAGGGTCCATCTCCAGTCCCAGGACACAGCAGCGGCCACCATGGCCACGCCTGGGC
TCCAGCAGCATCAGCAGCCCCAGGACCGGGGAGGCACAGGTGGCCCCACCACCCGGAGGA
GCAGCTCCTGCCCCTGTCCGGGGATGACTGATTCTCCTCCGCCAGGCCACCCAGAGGAGAA
GGCCACCCCGCCTGGAGGCACAGGCCATGAGGGGCTCTCAGGAGGTGCTGCTGATGTGGCTT
CTGGTGTTGGCAGTGGGCGGCACAGAGCACGCCTACCGGCCCGGCCGTAGGGTGTGTGCTGT
CCGGGCTCACGGGGACCCTGTCTCCGAGTCGTTCGTGCAGCGTGTGTACCAGCCCTTCCTCA
CCACCTGCGACGGGCACCGGGCCTGCAGCACCTACCGAACCATCTATAGGACCGCCTACCGC
CGCAGCCCTGGGCTGGCCCTGCCAGGCCTCGCTACGCGTGCTGCCCCGGCTGGAAGAGGAC
CAGCGGGCTTCCTGGGGCCTGTGGAGCAGCAATATGCCAGCCGCCATGCCGGAACGGAGGGA
GCTGTGTCCAGCCTGGCCGCTGCCGCTGCCCTGCAGGATGGCGGGGTGACACTTGCCAGTCA
GATGTGGATGAATGCAGTGCTAGGAGGGCGGCTGTCCCCAGCGCTGCATCAACACCGCCGG
CAGTTACTGGTGCCAGTGTTGGGAGGGGCACAGCCTGTCTGCAGACGGTACACTCTGTGTGC
CCAAGGGAGGGCCCCCCAGGGTGGCCCCCAACCCGACAGGAGTGGACAGTGCAATGAAGGAA
GAAGTGCAGAGGCTGCAGTCCAGGGTGGACCTGCTGGAGGAGAAGCTGCAGCTGGTGCTGGC
CCCACTGCACAGCCTGGCCTCGCAGGCACTGGAGCATGGGCTCCCGGACCCCGGCAGCCTCC
TGGTGCACTCCTTCCAGCAGCTCGGCCGCATCGACTCCCTGAGCGAGCAGATTTCCTTCCTG
GAGGAGCAGCTGGGGTCCTGCTCCTGCAAGAAAGACTCGTGACTGCCCAGCGCCCCAGGCTG
GACTGAGCCCCTCACGCCGCCCTGCAGCCCCCATGCCCCTGCCCAACATGCTGGGGGTCCAG
AAGCCACCTCGGGGTGACTGAGCGGAAGGCCAGGCAGGGCCTTCCTCCTCTTCCTCCTCCCC
TTCCTCGGGAGGCTCCCCAGACCCTGGCATGGGATGGGCTGGGATCTTCTCTGTGAATCCAC
CCCTGGCTACCCCCACCCTGGCTACCCCAACGGCATCCCAAGGCCAGGTGGGCCCTCAGCTG
AGGGAAGGTACGAGCTCCCTGCTGGAGCCTGGGACCCATGGCACAGGCCAGGCAGCCCGGAG
GCTGGGTGGGGCCTCAGTGGGGGCTGCTGCCTGACCCCAGCACAATAAAAATGAAACGTGA
AAAAAAAAAAAAAAAAAAAAAAAAAAAAAAAAAAAAAAAAGGGCGGCCGCGACTCTAGAGT
CGACCTGCAGAAGCTTGGCCGCCATGGCCCAACTTGTTTATTGCAGCTTATAATGGTTACAAAT

FIGURE 213

MRGSQEVLLMWLLVLAVGGTEHAYRPGRRVCAVRAHGDPVSESFVQRVYQPFLTTCDGHRAC
STYRTIYRTAYRRSPGLAPARPRYACCPGWKRTSGLPGACGAAICQPPCRNGGSCVQPGRCR
CPAGWRGDTCQSDVDECSARRGGCPQRCINTAGSYWCQCWEGHSLSADGTLCVPKGGPPRVA
PNPTGVDSAMKEEVQRLQSRVDLLEEKLQLVLAPLHSLASQALEHGLPDPGSLLVHSFQQLG
RIDSLSEQISFLEEQLGSCSCKKDS

Signal sequence:
1-19

FIGURE 214

GCCAGGCAGGTGGGCCTCAGGAGGTGCCTCCAGGCGGCCAGTGGGCCTGAGGCCCCAGCAAG
GGCTAGGGTCCATCTCCAGTCCCAGGACACAGCAGCGGCCACCATGGCCACGCCTGGGCTCC
AGCAGCATCAGAGCAGCCCCTGTGGTTGGCAGCAAAGTTCAGCTTGGCTGGGCCCGCTGTGA
GGGGCTTCGCGCTACGCCCTGCGGTGTCCCGAGGGCTGAGGTCTCCTCATCTTCTCCCTAGC
AGTGGATGAGCAACCCAACGGGGCCCGGGGAGGGGAACTGGCCCCGAGGGAGAGGAACCCC
AAAGCCACATCTGTAGCCAGGATGAGCAGTGTGAATCCAGGCAGCCCCAGGACCGGGGAGG
CACAGGTGGCCCCCACCACCCGGAGGAGCAGCTCCTGCCCCTGTCCGGGGATGACTGATTC
TCCTCCGCCAGGCCACCCAGAGGAGAAGGCCACCCCGCCTGGAGGCACAGGCCATGAGGGGC
TCTCAGGAGGTGCTGCTGATGTGGCTTCTGGTGTTGGCAGTGGGCGGCACAGAGCACGCCTA
CCGGCCCGGCCGTAGGGTGTGTGCTGTCCGGGCTCACGGGGACCCTGTCTCCGAGTCGTTCG
TGCAGCGTGTGTACCAGCCCTTCCTCACCACCTGCGACGGGCACCGGGCCTGCAGCACCTAC
CGAACCATCTATAGGACCGCCTACCGCCGCAGCCCTGGGCTGGCCCCTGCCAGGCCTCGCTA
CGCGTGCTGCCCCGGCTGGAAGAGGACCAGCGGGCTTCCTGGGGCCTGTGGAGCAGCAATAT
GCCAGCCGCCATGCCGGAACGGAGGGAGCTGTGTCCAGCCTGGCCGCTGCCGCTGCCCTGCA
GGATGGCGGGGTGACACTTGCCAGTCAGATGTGGATGAATGCAGTGCTAGGAGGGGCGGCTG
TCCCCAGCGCTGCATCAACACCGCCGGCAGTTACTGGTGCCAGTGTTGGGAGGGGCACAGCC
TGTCTGCAGACGGTACACTCTGTGTGCCCAAGGGAGGGCCCCCAGGGTGGCCCCCAACCCG
ACAGGAGTGGACAGTGCAATGAAGGAAGAAGTGCAGAGGCTGCAGTCCAGGGTGGACCTGCT
GGAGGAGAAGCTGCAGCTGGTGCTGGCCCCACTGCACAGCCTGGCCTCGCAGGCACTGGAGC
ATGGGCTCCCGGACCCCGGCAGCCTCCTGGTGCACTCCTTCCAGCAGCTCGGCCGCATCGAC
TCCCTGAGCGAGCAGATTTCCTTCCTGGAGGAGCAGCTGGGGTCCTGCTCCTGCAAGAAAGA
CTCGTGACTGCCCAGCGCTCCAGGCTGGACTGAGCCCCTCACGCCGCCCTGCAGCCCCCATG
CCCCTGCCCAACATGCTGGGGGTCCAGAAGCCACCTCGGGGTGACTGAGCGGAAGGCCAGGC
AGGGCCTTCCTCCTCTTCCTCCTCCCCTTCCTCGGGAGGCTCCCCAGACCCTGGCATGGGAT
GGGCTGGGATCTTCTCTGTGAATCCACCCCTGGCTACCCCACCCTGGCTACCCCAACGGCA
TCCCAAGGCCAGGTGGACCCTCAGCTGAGGGAAGGTACGAGCTCCCTGCTGGAGCCTGGGAC
CCATGGCACAGGCCAGGCAGCCCGGAGGCTGGGTGGGCCTCAGTGGGGCTGCTGCCTGAC
CCCCAGCACAATAAAAATGAAACGTG

FIGURE 215

MRGSQEVLLMWLLVLAVGGTEHAYRPGRRVCAVRAHGDPVSESFVQRVYQPFLTTCDGHRAC
STYRTIYRTAYRRSPGLAPARPRYACCPGWKRTSGLPGACGAAICQPPCRNGGSCVQPGRCR
CPAGWRGDTCQSDVDECSARRGGCPQRCINTAGSYWCQCWEGHSLSADGTLCVPKGGPPRVA
PNPTGVDSAMKEEVQRLQSRVDLLEEKLQLVLAPLHSLASQALEHGLPDPGSLLVHSFQQLG
RIDSLSEQISFLEEQLGSCSCKKDS

Signal sequence:
1-19

FIGURE 216

```
CCCACGCGTCCGAAGCTGGCCCTGCACGGCTGCAAGGGAGGCTCCTGTGGACAGGCCAGGCA
GGTGGGCCTCAGGAGGTGCCTCCAGGCGGCCAGTGGGCCTGAGGCCCCAGCAAGGGCTAGGG
TCCATCTCCAGTCCCAGGACACAGCAGCGGCCACCATGGCCACGCCTGGGCTCCAGCAGCAT
CAGCAGCCCCAGGACCGGGGAGGCACAGGTGGCCCCCACCACCCGGAGGAGCAGCTCCTGC
CCCTGTCCGGGGATGACTGATTCTCCTCCGCCAGGCCACCCAGAGGAGAAGGCCACCCCGC
CTGGAGGCACAGGCCATGAGGGGCTCTCAGGAGGTGCTGCTGATGTGGCTTCTGGTGTTGGC
AGTGGGCGGCACAGAGCACGCCTACCGGCCCGGCCGTAGGGTGTGTGCTGTCCGGGCTCACG
GGGACCCTGTCTCCGAGTCGTTCGTGCAGCGTGTGTACCAGCCCTTCCTCACCACCTGCGAC
GGGCACCGGCCTGCAGCACCTACCGAACCATCTATAGGACCGCCTACCGCCGCAGCCCTGG
GCTGGCCCCTGCCAGGCCTCGCTACGCGTGCTGCCCCGGCTGGAAGAGGACCAGCGGGCTTC
CTGGGGCCTGTGGAGCAGCAATATGCCAGCCGCCATGCCGGAACGGAGGGAGCTGTGTCCAG
CCTGGCCGCTGCCGCTGCCCTGCAGGATGGCGGGGTGACACTTGCCAGTCAGATGTGGATGA
ATGCAGTGCTAGGAGGGCGGCTGTCCCCAGCGCTGCGTCAACACCGCCGGCAGTTACTGGT
GCCAGTGTTGGGAGGGGCACAGCCTGTCTGCAGACGGTACACTCTGTGTGCCCAAGGGAGGG
CCCCCCAGGGTGGCCCCCAACCCGACAGGAGTGGACAGTGCAATGAAGGAAGAAGTGCAGAG
GCTGCAGTCCAGGGTGGACCTGCTGGAGGAGAAGCTGCAGCTGGTGCTGGCCCCACTGCACA
GCCTGGCCTCGCAGGCACTGGAGCATGGGCTCCCGGACCCCGGCAGCCTCCTGGTGCACTCC
TTCCAGCAGCTCGGCCGCATCGACTCCCTGAGCGAGCAGATTTCCTTCCTGGAGGAGCAGCT
GGGGTCCTGCTCCTGCAAGAAAGACTCGTGACTGCCCAGCGCCCCAGGCTGGACTGAGCCCC
TCACGCCGCCCTGCAGCCCCATGCCCCTGCCCAACATGCTGGGGGTCCAGAAGCCACCTCG
GGGTGACTGAGCGGAAGGCCAGGCAGGGCCTTCCTCCTCTTCCTCCTCCCCTTCCTCGGGAG
GCTCCCCAGACCCTGGCATGGGATGGGCTGGGATCTTCTCTGTGAATCCACCCCTGGCTACC
CCCACCCTGGCTACCCCAACGGCATCCCAAGGCCAGGTGGGCCCTCAGCTGAGGGAAGGTAC
GAGCTCCCTGCTGGAGCCTGGGACCCATGGCACAGGCCAGGCAGCCCGGAGGCTGGGTGGGG
CCTCAGTGGGGGCTGCTGCCTGACCCCAGCACAATAAAAATGAAACGTG
```

FIGURE 217

MRGSQEVLLMWLLVLAVGGTEHAYRPGRRVCAVRAHGDPVSESFVQRVYQPFLTTCDGHRAC
STYRTIYRTAYRRSPGLAPARPRYACCPGWKRTSGLPGACGAAICQPPCRNGGSCVQPGRCR
CPAGWRGDTCQSDVDECSARRGGCPQRCVNTAGSYWCQCWEGHSLSADGTLCVPKGGPPRVA
PNPTGVDSAMKEEVQRLQSRVDLLEEKLQLVLAPLHSLASQALEHGLPDPGSLLVHSFQQLG
RIDSLSEQISFLEEQLGSCSCKKDS

Signal sequence:
1-19

FIGURE 218

```
GGTTGCCACAGCTGGTTTAGGGCCCCGACCACTGGGGCCCCTTGTCAGGAGGAGACAGCCTCCCGGCCCGGGGAG
GACAAGTCGCTGCCACCTTTGGCTGCCGACGTGATTCCCTGGGACGGTCCGTTTCCTGCCGTCAGCTGCCGGCCG
AGTTGGGTCTCCGTGTTTCAGGCCGGCTCCCCCTTCCTGGTCTCCCTTCTCCCGCTGGGCCGGTTTATCGGGAGG
AGATTGTCTTCCAGGGCTAGCAATTGGACTTTTGATGATGTTTGACCCAGCGGCAGGAATAGCAGGCAACGTGAT
TTCAAAGCTGGGCTCAGCCTCTGTTTCTTCTCGTGTAATCGCAAAACCCATTTTGGAGCAGGAATTCCAATCA
TGTCTGTGATGGTGGTGAGAAAGAAGGTGACACGGAAATGGGAGAAACTCCCAGGCAGGAACACCTTTTGCTGTG
ATGGCCGCGTCATGATGGCCCGGCAAAAGGGCATTTTCTACCTGACCCTTTTCCTCATCCTGGGGACATGTACAC
TCTTCTTCGCCTTTGAGTGCCGCTACCTGGCTGTTCAGCTGTCTCCTGCCATCCCTGTATTTGCTGCCATGCTCT
TCCTTTTCTCCATGGCTACACTGTTGAGGACCAGCTTCAGTGACCCTGGAGTGATTCCTCGGGCGCTACCAGATG
AAGCAGCTTTCATAGAAATGGAGATAGAAGCTACCAATGGTGCGGTGCCCCAGGGCCAGCGACCACCGCCTCGTA
TCAAGAATTTCCAGATAAACAACCAGATTGTGAAACTGAAATACTGTTACACATGCAAGATCTTCCGGCCTCCCC
GGGCCTCCCATTGCAGCATCTGTGACAACTGTGTGGAGCGCTTCGACCATCACTGCCCCTGGGTGGGGAATTGTG
TTGGAAAGAGGAACTACCGCTACTTCTACCTCTTCATCCTTTCTCTCCCTCCTCACAATCTATGTCTTCGCCT
TCAACATCGTCTATGTGGCCCTCAAATCTTTGAAAATTGGCTTCTTGGAGACATTGAAAGAAACTCCTGGAACTG
TTCTAGAAGTCCTCATTTGCTTCTTTACACTCTGGTCCGTCGTGGGACTGACTGGATTTCATACTTTCCTCGTGG
CTCTCAACCAGACAACCAATGAAGACATCAAAGGATCATGGACAGGGAAGAATCGCGTCCAGAATCCCTACAGCC
ATGGCAATATTGTGAAGAACTGCTGTGAAGTGCTGTGTGGCCCCTTGCCCCCCAGTGTGCTGGATCGAAGGGGTA
TTTTGCCACTGGAGGAAAGTGGAAGTCGACCTCCCAGTACTCAAGAGACCAGTAGCAGCCTCTTGCCACAGAGCC
CAGCCCCCACAGAACACCTGAACTCAAATGAGATGCCGGAGGACAGCAGCACTCCCGAAGAGATGCCACCTCCAG
AGCCCCCAGAGCCACCACAGGAGGCAGCTGAAGCTGAGAAGTAGCCTATCTATGGAAGAGACTTTTGTTTGTGTT
TAATTAGGGCTATGAGAGATTTCAGGTGAGAAGTTAAACCTGAGACAGAGAGCAAGTAAGCTGTCCCTTTTAACT
GTTTTTCTTTGGTCTTTAGTCACCCAGTTGCACACTGGCATTTTCTTGCTGCAAGCTTTTTTAAATTTCTGAACT
CAAGGCAGTGGCAGAAGATGTCAGTCACCTCTGATAACTGGAAAAATGGGTCTCTTGGGCCCTGGCACTGGTTCT
CCATGGCCTCAGCCACAGGGTCCCCTTGGACCCCCTCTCTTCCCTCCAGATCCCAGCCCTCCTGCTTGGGGTCAC
TGGTCTCATTCTGGGGCTAAAAGTTTTTGAGACTGGCTCAAATCCTCCCAAGCTGCTGCACGTGCTGAGTCCAGA
GGCAGTCACAGAGACCTCTGGCCAGGGGATCCTAACTGGGTTCTTGGGGTCTTCAGGACTGAAGAGGAGGGAGAG
TGGGGTCAGAAGATTCTCCTGGCCACCAAGTGCCAGCATTGCCCACAAATCCTTTTAGGAATGGGACAGGTACCT
TCCACTTGTTGTANNNNNNNNNNNNNNNNNNNNNNNNNNNNNNNTTGTTTTTCCTTTTGACTCCTGCTCCCATTAGGAG
CAGGAATGGCAGTAATAAAAGTCTGCACTTTGGTCATTTCTTTTCCTCAGAGGAAGCCCGAGTGCTCACTTAAAC
ACTATCCCCTCAGACTCCCTGTGTGAGGCCTGCAGAGGCCCTGAATGCACAAATGGGAAACCAAGGCACAGAGAG
GCTCTCCTCTCCTCTCCCCCGATGTACCCTCAAAAAAAAAAAAATGCTAACCAGTTCTTCCATTAAGCCT
CGGCTGAGTGAGGGAAAGCCCAGCACTGCTGCCCTCTCGGGTAACTCACCCTAAGGCCTCGGCCCACCTCTGGCT
ATGGTAACCACACTGGGGGCTTCCTCCAAGCCCCGCTCTTCCAGCACTTCCACCGGCAGAGTCCCAGAGCCACTT
CACCCTGGGGGTGGGCTGTGGCCCCAGTCAGCTCTGCTCAGGACCTGCTCTATTTCAGGGAAGAAGATTTATGT
ATTATATGTGGCTATATTTCCTAGAGCACCTGTGTTTTCCTCTTTCTAAGCCAGGGTCCTGTCTGGATGACTTAT
GCGGTGGGGGAGTGTAAACCGGAACTTTTCATCTATTTGAAGGCGATTAAACTGTGTCTAATGCA
```

FIGURE 219

MSVMVVRKKVTRKWEKLPGRNTFCCDGRVMMARQKGIFYLTLFLILGTCTLFFAFECRYLAV
QLSPAIPVFAAMLFLFSMATLLRTSFSDPGVIPRALPDEAAFIEMEIEATNGAVPQGQRPPP
RIKNFQINNQIVKLKYCYTCKIFRPPRASHCSICDNCVERFDHHCPWVGNCVGKRNYRYFYL
FILSLSLLTIYVFAFNIVYVALKSLKIGFLETLKETPGTVLEVLICFFTLWSVVGLTGFHTF
LVALNQTTNEDIKGSWTGKNRVQNPYSHGNIVKNCCEVLCGPLPPSVLDRRGILPLEESGSR
PPSTQETSSSLLPQSPAPTEHLNSNEMPEDSSTPEEMPPPEPPEPPQEAAEAEK

Putative transmembrane domains:
amino acids 36-55 (type II TM), 65-84, 188-208, 229-245

FIGURE 220

AAAACCCTGTATTTTTTACAATGCAAATAGACAATNANCCTGGAGGTCTTTGAATTAGGTAT
TATAGGGATGGTGGGGTTGATTTTTNTTCCTGGAGGCTTTTGGCTTTGGACTCTCNCTTTCT
CCCACAGAGCNCTTCGACCATCACTGCCCCTGGGTGGGGAATTGTGTTGGAAAGAGGAACTA
CCGCTANTTCTACCTCTTCATCCTTTNTCTCTCCCNCCTCACAATCTATGTCTTCGCCTTCA
ACATCGT

FIGURE 221

GTTGTGTCCTTCAGCAAAACAGTGGATTTAAATCTCCTTGCACAAGCTTGAGAGCAACACAA
TCTATCAGGAAAGAAAGAAAGAAAAAACCGAACCTGACAAAAAGAAGAAAAGAAGAAGA
AAAAAAATC<u>ATG</u>AAAACCATCCAGCCAAAAATGCACAATTCTATCTCTTGGGCAATCTTCAC
GGGGCTGGCTGCTCTGTGTCTCTTCCAAGGAGTGCCCGTGCGCAGCGGAGATGCCACCTTCC
CCAAAGCTATGGACAACGTGACGGTCCGGCAGGGGGAGAGCGCCACCCTCAGGTGCACTATT
GACAACCGGGTCACCCGGGTGGCCTGGCTAAACGCAGCACCATCCTCTATGCTGGGAATGA
CAAGTGGTGCCTGGATCCTCGCGTGGTCCTTCTGAGCAACACCCAAACGCAGTACAGCATCG
AGATCCAGAACGTGGATGTGTATGACGAGGGCCCTTACACCTGCTCGGTGCAGACAGACAAC
CACCCAAAGACCTCTAGGGTCCACCTCATTGTGCAAGTATCTCCCAAAATTGTAGAGATTTC
TTCAGATATCTCCATTAATGAAGGGAACAATATTAGCCTCACCTGCATAGCAACTGGTAGAC
CAGAGCCTACGGTTACTTGGAGACACATCTCTCCCAAAGCGGTTGGCTTTGTGAGTGAAGAC
GAATACTTGGAAATTCAGGGCATCACCCGGGAGCAGTCAGGGACTACGAGTGCAGTGCCTC
CAATGACGTGGCCGCGCCCGTGGTACGGAGAGTAAAGGTCACCGTGAACTATCCACCATACA
TTTCAGAAGCCAAGGGTACAGGTGTCCCCGTGGGACAAAAGGGGACACTGCAGTGTGAAGCC
TCAGCAGTCCCCTCAGCAGAATTCCAGTGGTACAAGGATGACAAAAGACTGATTGAAGGAAA
GAAAGGGGTGAAAGTGGAAAACAGACCTTTCCTCTCAAAACTCATCTTCTTCAATGTCTCTG
AACATGACTATGGGAACTACACTTGCGTGGCCTCCAACAAGCTGGGCCACACCAATGCCAGC
ATCATGCTATTTGGTCCAGGCGCCGTCAGCGAGGTGAGCAACGGCACGTCGAGGAGGGCAGG
CTGCGTCTGGCTGCTGCCTCTTCTGGTCTTGCACCTGCTTCTCAAATTT<u>TGA</u>TGTGAGTGCC
ACTTCCCCACCCGGGAAAGGCTGCCGCCACCACCACCACCAACACAACAGCAATGGCAACAC
CGACAGCAACCAATCAGATATATACAAATGAAATTAGAAGAAACACAGCCTCATGGGACAGA
AATTTGAGGGAGGGGAACAAAGAATACTTTGGGGGGAAAAGAGTTTTAAAAAAGAAATTGAA
AATTGCCTTGCAGATATTTAGGTACAATGGAGTTTTCTTTTCCCAAACGGGAAGAACACAGC
ACACCCGGCTTGGACCCACTGCAAGCTGCATCGTGCAACCTCTTTGGTGCCAGTGTGGGCAA
GGGCTCAGCCTCTCTGCCCACAGAGTGCCCCACGTGGAACATTCTGGAGCTGGCCATCCCA
AATTCAATCAGTCCATAGAGACGAACAGAATGAGACCTTCCGGCCCAAGCGTGGCGCTGCGG
GCACTTTGGTAGACTGTGCCACCACGGCGTGTGTTGTGAAACGTGAAATAAAAGAGCAAAA
AAAAA

FIGURE 222

MKTIQPKMHNSISWAIFTGLAALCLFQGVPVRSGDATFPKAMDNVTVRQGESATLRCTIDNR
VTRVAWLNRSTILYAGNDKWCLDPRVVLLSNTQTQYSIEIQNVDVYDEGPYTCSVQTDNHPK
TSRVHLIVQVSPKIVEISSDISINEGNNISLTCIATGRPEPTVTWRHISPKAVGFVSEDEYL
EIQGITREQSGDYECSASNDVAAPVVRRVKVTVNYPPYISEAKGTGVPVGQKGTLQCEASAV
PSAEFQWYKDDKRLIEGKKGVKVENRPFLSKLIFFNVSEHDYGNYTCVASNKLGHTNASIML
FGPGAVSEVSNGTSRRAGCVWLLPLLVLHLLLKF

Signal peptide:
amino acids 1-28

FIGURE 223

```
GAAAAAAAATCATGAAAACCATCCAGCCAAAAATGCACAATTCTATCTCTTGGGCAATCTTC
ACGGGGCTGGCTGCTCTGTGTCTCTTCCAAGGAGTGCCCGTGCGCAGCGGAGATGCCACCTT
CCCCAAAGCTATGGACAACGTGACGGTCCGGCAGGGGAGAGCGCCACCCTCAGGTGCACTA
TTGACAACCGGGTCACCCGGGTGGCCTGGCTAAACCGCAGCACCATCCTCTATGCTGGGAAT
GACAAGTGGTGCCTGGATCCTCGCGTGGTCCTTCTGAGCAACACCCAAACGCAGTACAGCAT
CGAGATCCAGAACGTGGATGTGTATGACGAGGGCCCTTACACCTGCTCGGTGCAGACAGACA
ACCACCCAAAGACCTCTAGGGTCCACCTCATTGTGCAAGTATCTCCCAAAATTGTAGAGATT
TCTTCAGATATCTCCATTAATGAAGGGAACAATATTAGCCTCACCTGCATAGCAACTGGTAG
ACCAGAG
```

FIGURE 224

ATGGCTGGTGACGGCGGGGCCGGGCAGGGGACCGGGGCCGCGGCCCGGGAGCGGGCCAGCTGCCGGGAGCCCTGA
ATCACCGCCTGGCCCGACTCCACCATGAACGTCGCGCTGCAGGAGCTGGGAGCTGGCAGCAACGTGGGATTCCAG
AAGGGGACAAGACAGCTGTTAGGCTCACGCACGCAGCTGGAGCTGGTCTTAGCAGGTGCCTCTCTACTGCTGGCT
GCACTGCTTCTGGGCTGCCTTGTGGCCCTAGGGGTCCAGTACCACAGAGACCCATCCCACAGCACCTGCCTTACA
GAGGCCTGCATTCGAGTGGCTGGAAAAATCCTGGAGTCCCTGGACCGAGGGGTGAGCCCCTGTGAGGACTTTTAC
CAGTTCTCCTGTGGGGCTGGATTCGGAGGAACCCCCTGCCCGATGGGCGTTCTCGCTGGAACACCTTCAACAGC
CTCTGGGACCAAAACCAGGCCATACTGAAGCACCTGCTTGAAAACACCACCTTCAACTCCAGCAGTGAAGCTGAG
CAGAAGACACAGCGCTTCTACCTATCTTGCCTACAGGTGGAGCGCATTGAGGAGCTGGGAGCCCAGCCACTGAGA
GACCTCATTGAAGATTGGTGGTTGGAACATTACGGGCCCTGGGACCAGGACAACTTTATGGAGGTGTTGAAG
GCAGTAGCAGGGACCTACAGGGCCACCCCATTCTTCACCGTCTACATCAGTGCCGACTCTAAGAGTTCCAACAGC
AATGTTATCCAGGTGGACCAGTCTGGGCTCTTTCTGCCCTCTCGGGATTACTACTTAAACAGAACTGCCAATGAG
AAAGTGCTCACTGCCTATCTGGATTACATGGAGGAACTGGGGATGCTGCTGGGTGGCGGCCCACCTCCACGAGG
GAGCAGATGCAGCAGGTGCTGGAGTTGGAGATACAGCTGGCCAACATCACAGTGCCCCAGGACCAGCGGCGCGAC
GAGGAGAAGATCTACCACAAGATGAGCATTTCGGAGCTGCAGGCTCTGGCGCCCTCCATGGACTGGCTTGAGTTC
CTGTCTTTCTTGCTGTCACCATTGGAGTTGAGTGACTCTGAGCCTGTGGTGGTGTATGGGATGGATTATTTGCAG
CAGGTGTCAGAGCTCATCAACCGCACGGAACCAAGCATCCTGAACAATTACCTGATCTGGAACCTGGTGCAAAAG
ACAACCTCAAGCCTGGACCGACGCTTTGAGTCTGCACAAGAGAAGCTGCTGGAGACCCTCTATGGCACTAAGAAG
TCCTGTGTGCCGAGGTGGCAGACCTGCATCTCCAACACGGATGACGCCCTTGGCTTTGCTTTGGGGTCACTCTTC
GTGAAGGCCACGTTTGACCGGCAAAGCAAAGAAATTGCAGAGGGGATGATCAGCGAAATCCGGACCGCATTTGAG
GAGGCCCTGGGACAGCTGGTTTGGATGGATGAGAAGACCCGCCAGGCAGCCAAGGAGAAAGCAGATGCCATCTAT
GATATGATTGGTTTCCCAGACTTTATCCTGGAGCCCAAAGAGCTGGATGATGTTTATGACGGGTACGAAATTTCT
GAAGATTCTTTCTTCCAAAACATGTTGAATTTGTACAACTTCTCTGCCAAGGTTATGGCTGACCAGCTCCGCAAG
CCTCCCAGCCGAGACCAGTGGAGCATGACCCCCAGACAGTGAATGCCTACTACCTTCCAACTAAGAATGAGATC
GTCTTCCCCGCTGGCATCCTGCAGGCCCCCTTCTATGCCCGCAACCACCCCAAGGCCCTGAACTTCGGTGGCATC
GGTGTGGTCATGGGCCATGAGTTGACGCATGCCTTTGATGACCAAGGGCGCGAGTATGACAAAGAAGGGAACCTG
CGGCCCTGGTGGCAGAATGAGTCCCTGGCAGCCTTCCGGAACCACACGGCCTGCATGGAGGAACAGTACAATCAA
TACCAGGTCAATGGGGAGAGGCTCAACGGCCGCCAGACGCTGGGGGAGAACATTACTGACAACGGGGGCTGAAG
GCTGCCTACAATGCTTACAAAGCATGGCTGAGAAAGCATGGGGAGGAGCAGCAACTGCCAGCCGTGGGGCTCACC
AACCACCAGCTCTTCTTCGTGGGATTTGCCCAGGTGTGGTGCTCGGTCCGCACACCAGAGAGCTCTCACGAGGGG
CTGGTGACCGACCCCCACAGCCCTGCCCGCTTCCGCGTGCTGGGCACTCTCTCCAACTCCCGTGACTTCCTGCGG
CACTTCGGCTGCCCTGTCGGCTCCCCCATGAACCCAGGGCAGCTGTGTGAGGTGTGGTAGACCTGGATCAGGGGA
GAAATGGCCAGCTGTCACCAGACCTGGGGCAGCTCTCCTGACAAAGCTGTTTGCTCTTGGGTTGGGAGGAAGCAA
ATGCAAGCTGGGCTGGGTCTAGTCCCTCCCCCCACAGGTGACATGAGTACAGACCCTCCTCAATCACCACATTG
TGCCTCTGCTTTGGGGGTGCCCCTGCCTCCAGCAGAGCCCCCACCATTCACTGTGACATCTTTCCGTGTCACCCT
GCCTGGAAGAGGTCTGGGTGGGGAGGCCAGTTCCCATAGGAAGGAGTCTGCC

FIGURE 225

MNVALQELGAGSNVGFQKGTRQLLGSRTQLELVLAGASLLLAALLLGCLVALGVQYHRDPSH
STCLTEACIRVAGKILESLDRGVSPCEDFYQFSCGGWIRRNPLPDGRSRWNTFNSLWDQNQA
ILKHLLENTTFNSSSEAEQKTQRFYLSCLQVERIEELGAQPLRDLIEKIGGWNITGPWDQDN
FMEVLKAVAGTYRATPFFTVYISADSKSSNSNVIQVDQSGLFLPSRDYYLNRTANEKVLTAY
LDYMEELGMLLGGRPTSTREQMQQVLELEIQLANITVPQDQRRDEEKIYHKMSISELQALAP
SMDWLEFLSFLLSPLELSDSEPVVVYGMDYLQQVSELINRTEPSILNNYLIWNLVQKTTSSL
DRRFESAQEKLLETLYGTKKSCVPRWQTCISNTDDALGFALGSLFVKATFDRQSKEIAEGMI
SEIRTAFEEALGQLVWMDEKTRQAAKEKADAIYDMIGFPDFILEPKELDDVYDGYEISEDSF
FQNMLNLYNFSAKVMADQLRKPPSRDQWSMTPQTVNAYYLPTKNEIVFPAGILQAPFYARNH
PKALNFGGIGVVMGHELTHAFDDQGREYDKEGNLRPWWQNESLAAFRNHTACMEEQYNQYQV
NGERLNGRQTLGENITDNGGLKAAYNAYKAWLRKHGEEQQLPAVGLTNHQLFFVGFAQVWCS
VRTPESSHEGLVTDPHSPARFRVLGTLSNSRDFLRHFGCPVGSPMNPGQLCEVW

Type II Transmembrane domain:
amino acids 32-57

FIGURE 226

```
GCCCGGCCCTCCGCCCTCCGCACTCCCGCCTCCCTCCCTCCGCCCGCTCCCGCGCCCTCCTCCCTCCCTCCTCCC
CAGCTGTCCCGTTCGCGTCATGCCGAGCCTCCCGGCCCCGCCGGCCCCGCTGCTGCTCCTCGGGCTGCTGCTGCT
CGGCTCCCGGCCGGCCCGCGGCGCCGGCCCAGAGCCCCCGTGCTGCCCATCCGTTCTGAGAAGGAGCCGCTGCC
CGTTCGGGGAGCGGCAGGTAGGTGGGCGCCCGGGGAGGCGCGGGCGGGGAGTCGGGCTCGGGGCGAGTCAGCGC
CAGCCCGGAGGGGGCGCGGGGCGCAGGTGGCTCGGCGCGGCGGGCGGCCCGGAGGGTGGGCGGGGGCAGAAGGGC
GCGGTGCCTGGGACCCGGGACCCGCGGGCAGCCCCGGGGCGGCACACGGCGCGAGCTGGGCAGCGGCCTCCAGC
CAAGCCCGTCCCCGCAGGCTGCACCTTCGGCGGGAAGGTCTATGCCTTGGACGAGACGTGGCACCCGGACCTAGG
GGAGCCATTCGGGGTGATGCGCTGCGTGCTGTGCGCCTGCGAGGCGCAGTGGGGTCGCCGTACCAGGGGCCCTGG
CAGGGTCAGCTGCAAGAACATCAAACCAGAGTGCCCAACCCCGGCCTGTGGGCAGCCGCGCCAGCTGCCGGGACA
CTGCTGCCAGACCTGCCCCCAGGACTTCGTGGCGCTGCTGACAGGGCCGAGGTCGCAGGCGGTGGCACGAGCCCG
AGTCTCGCTGCTGCGCTCTAGCCTCCGCTTCTCTATCTCCTACAGGCGGCTGGACCGCCCTACCAGGATCCGCTT
CTCAGACTCCAATGGCAGTGTCCTGTTTGAGCACCCTGCAGCCCCCACCCAAGATGGCCTGGTCTGTGGGGTGTG
GCGGGCAGTGCCTCGGTTGTCTCTGCGGCTCCTTAGGGCAGAACAGCTGCATGTGGCACTTGTGACACTCACTCA
CCCTTCAGGGGAGGTCTGGGGGCCTCTCATCCGGCACCGGGCCCTGTCCCCAGAGACCTTCAGTGCCATCCTGAC
TCTAGAAGGCCCCCACCAGCAGGGCGTAGGGGGCATCACCCTGCTCACTCTCAGTGACACAGAGGACTCCTTGCA
TTTTTTGCTGCTCTTCCGAGGCCTTGCAGGACTAACCCAGGTTCCCTTGAGGCTCCAGATTCTACACCAGGGGCA
GCTACTGCGAGAACTTCAGGCCAATGTCTCAGCCCAGGAACCAGGCTTTGCTGAGGTGCTGCCCAACCTGACAGT
CCAGGAGATGGACTGGCTGGTGCTGGGGGAGCTGCAGATGGCCCTGGAGTGGGCAGGCAGGCCAGGGCTGCGCAT
CAGTGGACACATTGCTGCCAGGAAGAGCTGCGACGTCCTGCAAAGTGTCCTTTGTGGGGCTAATGCCCTGATCCC
AGTCCAAACGGGTGCTGCCGGCTCAGCCAGCCTCACTCTGCTAGGAAATGGCNCCCTGATCCTCCAGGTGCAATT
GGTAGGGACAACCAGTGAGGTGGTGGCCATGACACTGGAAACCAAGCCTCAGCGGAGGGATCAGCCCACTGTCCT
GTGCCACATGGCTGGCCTATCCTCCCCTGCCCCCAGGCCGTGGGTATCTGCCCTGGGCTGGGGTGCCCGAGGGGC
TCATATGCTGCTGCAGAATGAGCTCTTCCTGAACGTGGGCACCAAGGACTTCCCAGACGGAGAGCTTCGGGGCA
ACGTGGCTGCCCTGCCCTACTGTGGGGCATAGCGCCCGCCCTGCCCGTGCCCCTAGCAGGAGCCCTGGTGCTACC
CCCTGTGAAGAGCCAAGCAGCAGGGCACGCCTGGCTTTCCTTGGATACCCACTGTCACCTGCACTATGAAGTGCT
GCTGGCTGGGCTTGGTGGCTCAGAACAAGGCACTGTCACTGCCCACCTCCTTGGGCCTCCTGGAACGCCAGGGCC
TCGGCGGCTGCTGAAGGGATTCTATGGCTCAGAGGCCCAGGGTGTGGTGAAGGACCTGGAGCCGGAACTGCTGCG
GCACCTGGCAAAAGGCATGGCTTCCCTGATGATCACCACCAAGGTAGCCCCAGAGGGGAGCTCCGAGGGCAGCCT
CTCCTCCCAGGTGCACATAGCCAACCAATGTGAGGTTGGCGGACTGCGCCTGGAGGCGGCCGGGGCCGAGGGGGT
GCGGGCGCTGGGGGCTCCGGATACAGCCTCTGCTGCGCCGCCTGTGGTGCCTGGTCTCCCGGCCCTAGCGCCCGC
CAAACCTGGTGGTCCTGGGCGGCCCCGAGACCCCAACACATGCTTCTTCGAGGGGCAGCAGCGCCCCCACGGGGC
TCGCTGGGCGCCCAACTACGACCCGCTCTGCTCACTCTGCACCTGCCAGAGACGAACGGTGATCTGTGACCCGGT
GGTGTGCCCACCGCCCAGCTGCCCACACCCGGTGCAGGCTCCCGACCAGTGCTGCCCTGTTTGCCCTGGCTGCTA
TTTTGATGGTGACCGGAGCTGGCGGGCAGCGGGTACGCGGGTGGCACCCCGTTGTGCCCCCCTTTGGCTTAATTAA
GTGTGCTGTCTGCACCTGCAAGCAGGGGGGCACTGAGAGGTGCACTGTGAGAAGGTGCAGTGTCCCCGGCTGGC
CTGTGCCCAGCCTGTGCGTGTCAACCCCACCGACTGCTGCAAACAGTGTCCAGGTGAGGCCCACCCCCAGCTGGG
GGACCCCATGCAGGCTGATGGCCCCGGGCTGCCGTTTTGCTGGGCAGTGGTTCCCAGAGAGTCAGAGCTGGCA
CCCCTCAGTGCCCCCGTTTGGAGAGATGAGCTGTATCACCTGCAGATGTGGGGTAAGTGGGGAGCAGAGGCTTGT
GTGAGGTGGGTACTGGGAGCCTGGTCTGGAGTAGGGAGACCTTCCCAGGGAGGTCCCTGAAGAAGCTGAAGGTCA
CTGTGTCCCAGTGCCTCTGGGGACACTCAGTGTCTGCTCTGTCTTGTACCAGGCAGGGGTGCCTCACTGTGAGC
GGGATGACTGTTCACTGCCACTGTCCTGTGGCTCGGGGAAGGAGAGTCGATGCTGTTCCCGCTGCACGGCCCACC
GGCGGCGTAAGTGAGGGAGTCCAGGGTCAGCAGCTGTGAGTGGAGGGCTCACCTGCCTGTGGGACTCCTGATCAG
GGAAGGGAGCACTCACTGTGTGCAGGACAGTGCAGCCTGCCTCACAAGTGCCATTCCAATCCACCCTCACAGCA
ACCTGGTGGAATTGTTATTTATGACCTTTTCTTTACAAATGAGATTTCTGAAGCTCAGAGAAATTAAGCAACGAG
ATGAAGGTCACCCAGCTGTGTGCACTGACCTGTTTAGAAAATACTGGCCTTTCTGGGACCAAGGCAGGGATGCTT
TGCCCTGCCCTCTATGCCTCTCTGTGCCTCTCCACTCCCTCTCCCTCCTCCAACATTCCCTCCCTTCTGTCTCC
AGCAGCCCCAGAGACCAGAACTGATCCAGAGCTGGAGAAAGAAGCCGAAGGCTCTTAGGGAGCAGCCAGAGGGCC
AAGTGACCAAGAGGATGGGGCCTGAGCTGGGGAAGGGGTGGCATCGAGGACCTTCTTGCATTCTCCTGTGGGAAG
CCCAGTGCCTTTGCTCCTCTGTCCTGCCTCTACTCCCACCCCCACTACCTCTGGGAACCACAGCTCCACAAGGGG
GAGAGGCAGCTGGCCAGACCGAGGTCACAGCCACTCCAAGTCCTGCCCTGCCACCCTCGGCCTCTGTCCTGGAA
GCCCCACCCCTTTCTTCCTGTACATAATGTCACTGGCTTGTTGGGATTTTTAATTTATCTTCACTCAGCACCAAG
GGCCCCGGACACTCCACTCCTGCTGCCCCTGAGCTGAGCAGAGTCATTATTGGAGAGTTTTGTATTTATTAAAAC
ATTTCTTTTTCAGTCTTTGGGCATGAGGTTGGCTCTTTGTGGCCAGGAACCTGAGTGGGGCCTGGTGGAGAAGGG
GCNGAGAGTAGGAGGTGAGAGAGAGGAGCTCTGACACTTGGGGAGCTGAAAGAGACCTGGAGAGGCAGAGGATAG
CGTGGCNNTTGGCTGGCATNCCTGGGTTCCGCAGAGGGGCTGGGGATGGTTCTTGAGATGGTCTAGAGACTCAAG
AATTTAGGGAAGTAGAAGCAGGATTTTGACTCAAGTTTAGTTTCCCACATCGCTGGCCTGTTTGCTGACTTCATG
TTTGAAGTTGCTCCAGAGAGAGAATCAAAGGTGTCACCAGCCCCTCTCTCCCTCCTTCCCTTCCCTTCCCTTTCT
TTCCCTCCCCTCCCCTCCCCTCCCCTCCCCTCC
```

FIGURE 227

```
GGCCGAGCGGGGGTGCTGCGCGGCGGCCGTGATGGCTGGTGACGGCGGGGCCGGGCAGGGGA
CCGGGGCCGCGGCCCGGGAGCGGGCCAGCTGCCGGGAGCCCTGAATCACCGCCTGGCCCGAC
TCCACCATGAACGTCGCGCTGCAGGAGCTGGGAGCTGGCAGCAACGTGGGATTCCAGAAGGG
GACAAGACAGCTGTTAGGCTCACGCACGCAGCTGGAGCTGGTCTTAGCAGGTGCCTCTCTAC
TGCTGGCTGCACTGCTTCTGGGCTGCCTTGTGGCCCTAGGGGTCCAGTACCACAGAGACCCA
TCCCACAGCACCTGCCTTACAGAGGCCTGCATTCGAGTGGCTGGAAAAATCCTGGAGTCCCT
GGACCGAGGGGTGAGCCCCTGTGAGGACTTTTACCAGTTCTCCTGTGGGGCTGGATTCGGA
GGAACCCCCTGCCCGATGGGCGTTCTCGCTGGAACACCTTCAACAGCCTCTGGGACCAAAAC
CAGGCCATACTGAAGCACCTGCTTGAAAACACCACCTTCAACTCCAGCAGTGAAGCTGAGCA
GAAGACACAGCGCTTCTACCTATCTTGCCTACAGGTGGAGCGCATTGAGGAGCTGGGAGCCC
AGCCACTGAGAGACCTCATTGAGAAGATTGGTGGTTGGAACATTACGGGGCCCTGGGACCAG
GACAACTTTATGGAGGTGTTGAAGGCAGTAGCAGGGACCTACAGGGCCACCCCATTCTTCAC
CGTCTACATCAGTGCCGACTCTAAGAGTTCCAACAGCAATGTTATCCAGGTGGACCAGTCTG
GGCTCTTTCTGCCCTCTCGGGATTACTACTTAAACAGAACTGCCAATGAGAAAGTAAGGAAC
ATCTTCCGAACCCCCATCCCTACCCCTGGCTGAGCTGGGCTGATCCCTGTTGACTTTTCCCT
TTGCCAAGGGTCAGAGCAGGGAAGGTGAGCCTATCCTGTCACCTAGTGAACAAACTGCCCCT
CCTTTCTTTCTTCTTTTCTTCCTCCCTCCCTCCCTTTCTTCCCCTTTTCCTTCCTTCCTTCC
TCTTATTCTTCTAGTAGGTTTCATAGACACCTACTGTGTGCCAGGTCCAGTGGGGGAATTCG
GAGATATAAGTTTCCGAGCCATTGCCACAGGAAGCGTTCAGTGTCGATGGGTTCATGGACCT
AGATAGGCTGATAACAAAGCTCACAAGAGGGTCCTGAGGATTCAGGAGAGACTTATGGAGCC
AGCAAAGTCTTCCTGAAGAGATTGCATTTGAGCCAGGTCCTGTAG
```

FIGURE 228

ATGCCTACTACCTTCCAACTAAGAATGAGATCGTCTTCCCCGCTGGCATCCTGCAGGCCCCC
TTCTATGCCCGCAACCACCCCAAGGCCCTGAACTTCGGTGGCATCGGTGTGGTCATGGGCCA
TGAGTTGACGCATGCCTTTGATGACCAAGGGCGCGAGTATGACAAAGAAGGGAACCTGCGGC
CCTGGTGGCAGAATGAGTCCCTGGCAGCCTTCCGGAACCACACGGCCTGCATGGAGGAACAG
TACAATCAATACCAGGTCAATGGGGAGAGGCTCAACGGCCGCCAGACGCTGGGGAGAACAT
TGCTGACAACGGGGGGCTGAAGGCTGCCTACAATGCTTACAAAGCATGGCTGAGAAAGCATG
GGGAGGAGCAGCAACTGCCAGCCGTGGGGCTCACCAACCACCAGCTCTTCTTCGTGGGATTT
GCCCAGGTGTGGTGCTCGGTCCGCACACCAGAGAGCTCTCACGAGGGGCTGGTGACCGACCC
CCACAGCCCTGCCCGCTTCCGCGTGCTGGGCACTCTCTCCAACTCCCGTGACTTCCTGCGGC
ACTTCGGCTGCCCTGTCGGCTCCCCATGAACCCAGGGCAGCTGTGTGAGGTGTGGTAGACC
TGGATCAGGGGAGAAATGGCCAGCTGTCACCAGACCTGGGGCAGCTCTCCTGACAAAGCTGT
TTGCTCTTGGGTTGGGAGGAAGCAAATGCAAGCTGGGCTGGTCTAGTCCCTCCCCCCCACA
GGTGACATGAGTACAGACCCTCCTCAATCACCACATTGTGCCTCTGCTTTGGGGGTGCCCCT
GCCTCCAGCAGAGCCCCCACCATTCACTGTGACATCTTTCCGTGTCACCCTGCCTGGAAGAG
GTCTGGGTGGGGAGGCCAGTTCCCATAGGAAGGAGTCTGCCTCTTCTGTCCCCAGGCTCACT
CAGCCTGGCGGCCATGGGGCCTGCCGTGCCTGCCCCACTGTGACCCACAGGCCTGGGTGGTG
TACCTCCTGGACTTCTCCCCAGGCTCACTCAGTGCGCACTTAGGGGTGGACTCAGCTCTGTC
TGGCTCACCCTCACGGGCTACCCCCACCTCACCCTGTGCTCCTTGTGCCACTGCTCCCAGTG
CTGCTGCTGACCTTCACTGACAGCTCCTAGTGGAAGCCCAAGGGCCTCTGAAAGCCTCCTGC
TGCCCACTGTTTCCCTGGGCTGAGAGGGGAAGTGCATATGTGTAGCGGGTACTGGTTCCTGT
GTCTTAGGGCACAAGCCTTAGCAAATGATTGATTCTCCCTGGACAAAGCAGGAAAGCAGATA
GAGCAGGGAAAAGGAAGAACAGAGTTTATTTTTACAGAAAAGAGGGTGGGAGGGTGTGGTCT
TGGCCCTTATAGGACC

FIGURE 229

CCCACGCGTCCGAGCCGCCCGAGAATTAGACACACTCCGGACGCGGCCAAAAGCAACCGAGA
GGAGGGGAGGCAAAAACACCGAAAAACAAAAAGAGAGAAACAACACCCAACAACTGGGGTGG
GGGGAAGAAAGAAAGAAAAGAAACCCACCCACCCACCAAAAAAAAAAAAAAAAAAAAAAAAA
AAAAAAAAAAAATCCTGTGGCGCGCCGCCTGGTTCCCGGGAAGACTCGCCAGCACCAGGGGG
TGGGGGAGTGCGAGCTGAAAGCTGCTGGAGAGTGAGCAGCCCTAGCAGGGATGGACATGATG
CTGTTGGTGCAGGGTGCTTGTTGCTCGAACCAGTGGCTGGCGGCGGTGCTCCTCAGCCTGTG
CTGCCTGCTACCCTCCTGCCTCCCGGCTGGACAGAGTGTGGACTTCCCTGGGCGGCCGTGG
ACAACATGATGGTCAGAAAGGGGACACGGCGGTGCTTAGGTGTTATTTGGAAGATGGAGCT
TCAAAGGGTGCCTGGCTGAACCGGTCAAGTATTATTTTTGCGGGAGGTGATAAGTGGTCAGT
GGATCCTCGAGTTTCAATTTCAACATTGAATAAAAGGGACTACAGCCTCCAGATACAGAATG
TAGATGTGACAGATGATGGCCCATACACGTGTTCTGTTCAGACTCAACATACACCCAGAACA
ATGCAGGTGCATCTAACTGTGCAAGTTCCTCCTAAGATATATGACATCTCAAATGATATGAC
CGTCAATGAAGGAACCAACGTCACTCTTACTTGTTTGGCCACTGGGAAACCAGAGCCTTCCA
TTTCTTGGCGACACATCTCCCCATCAGCAAAACCATTTGAAAATGGACAATATTTGGACATT
TATGGAATTACAAGGGACCAGGCTGGGGAATATGAATGCAGTGCGGAAAATGCTGTGTCATT
CCCAGATGTGAGGAAAGTAAAAGTTGTTGTCAACTTTGCTCCTACTATTCAGGAAATTAAAT
CTGGCACCGTGACCCCCGGACGCAGTGGCCTGATAAGATGTGAAGGTGCAGGTGTGCCGCCT
CCAGCCTTTGAATGGTACAAAGGAGAGAAGAAGCTCTTCAATGGCCAACAAGGAATTATTAT
TCAAAATTTTAGCACAAGATCCATTCTCACTGTTACCAACGTGACACAGGAGCACTTCGGCA
ATTATACCTGTGTGGCTGCCAACAAGCTAGGCACAACCAATGCGAGCCTGCCTCTTAACCCT
CCAAGTACAGCCCAGTATGGAATTACCGGGAGCGCTGATGTTCTTTTCTCCTGCTGGTACCT
TGTGTTGACACTGTCCTCTTTCACCAGCATATTCTACCTGAAGAATGCCATTCTACAATAAA
TTCAAAGACCCATAAAAGGCTTTTAAGGATTCTCTGAAAGTGCTGATGGCTGGATCCAATCT
GGTACAGTTTGTTAAAAGCAGCGTGGGATATAATCAGCAGTGCTTACATGGGGATGATCGCC
TTCTGTAGAATTGCTCATTATGTAAATACTTTAATTCTACTCTTTTTTGATTAGCTACATTA
CCTTGTGAAGCAGTACACATTGTCCTTTTTTTAAGACGTGAAAGCTCTGAAATTACTTTTAG
AGGATATTAATTGTGATTTCATGTTTGTAATCTACAACTTTTCAAAAGCATTCAGTCATGGT
CTGCTAGGTTGCAGGCTGTAGTTTACAAAAACGAATATTGCAGTGAATATGTGATTCTTTAA
GGCTGCAATACAAGCATTCAGTTCCCTGTTTCAATAAGAGTCAATCCACATTTACAAAGATG
CATTTTTTTCTTTTTTGATAAAAAGCAAATAATATTGCCTTCAGATTATTTCTTCAAAATA
TAACACATATCTAGATTTTTCTGCTTGCATGATATTCAGGTTTCAGGAATGAGCCTTGTAAT
ATAACTGGCTGTGCAGCTCTGCTTCTCTTTCCTGTAAGTTCAGCATGGGTGTGCCTTCATAC
AATAATATTTTTCTCTTTGTCTCCAACTAATATAAAATGTTTGCTAAATCTTACAATTTGA
AAGTAAAAATAAACCAGAGTGATCAAGTTAAACCATACACTATCTCTAAGTAACGAAGGAGC
TATTGGACTGTAAAAATCTCTTCCTGCACTGACAATGGGGTTTGAGAATTTTGCCCCACACT
AACTCAGTTCTTGTGATGAGAGACAATTTAATAACAGTATAGTAAATATACCATATGATTTC
TTTAGTTGTAGCTAAATGTTAGATCCACCGTGGGAAATCATTCCCTTTAAAATGACAGCACA
GTCCACTCAAAGGATTGCCTAGCAATACAGCATCTTTTCCTTTCACTAGTCCAAGCCAAAAA
TTTTAAGATGATTTGTCAGAAAGGGCACAAAGTCCTATCACCTAATATTACAAGAGTTGGTA
AGCGCTCATCATTAATTTTATTTTGTGGCAGGTATTATGACAGTCGACCTGGAGGGTATGGA
TATGGATATGGACGTTCCAGAGACTATAATGGCAGAAACCAGGGTGGTTATGACCGCTACTC
AGGAGGAAATTACAGAGACAATTATGACAACTGAAATGAGACATGCACATAATATAGATACA
CAAGGAATAATTTCTGATCCAGGATCGTCCTTCCAAATGGCTGTATTTATAAAGGTTTTTGG
AGCTGCACTGAAGCATCTTATTTTATAGTATATCAACCTTTTGTTTTTAAATTGACCTGCCA
AGGTAGCTGAAGACCTTTTAGACAGTTCCATCTTTTTTTTTAAATTTTTTCTGCCTATTTAA
AGACAAATTATGGGACGTTTGTCAAAAAAAAAAAAAAAAAAAAAAAAA

FIGURE 230

MMLLVQGACCSNQWLAAVLLSLCCLLPSCLPAGQSVDFPWAAVDNMMVRKGDTAVLRCYLED
GASKGAWLNRSSIIFAGGDKWSVDPRVSISTLNKRDYSLQIQNVDVTDDGPYTCSVQTQHTP
RTMQVHLTVQVPPKIYDISNDMTVNEGTNVTLTCLATGKPEPSISWRHISPSAKPFENGQYL
DIYGITRDQAGEYECSAENAVSFPDVRKVKVVVNFAPTIQEIKSGTVTPGRSGLIRCEGAGV
PPPAFEWYKGEKKLFNGQQGIIIQNFSTRSILTVTNVTQEHFGNYTCVAANKLGTTNASLPL
NPPSTAQYGITGSADVLFSCWYLVLTLSSFTSIFYLKNAILQ

Important features of the protein:
Signal peptide:
amino acids 1-31

Transmembrane domain:
amino acids 326-345

N-glycosylation sites.
amino acids 71-75, 153-157, 273-277, 284-288, 292-296, 305-309

Casein kinase II phosphorylation site.
amino acids 147-151, 208-212, 224-228

Tyrosine kinase phosphorylation site.
amino acids 178-186

N-myristoylation sites.
amino acids 7-13, 63-70, 67-73, 151-157, 239-245, 291-297, 302-308, 319-325

Myelin P0 protein:
amino acids 92-121

FIGURE 231

```
AGTGGTTCGATGGGAAGGATCTTTCTCCAAGTGGTTCCTCTTGAGGGGAGCATTTCTGCTGG
CTCCAGGACTTTGGCCATCTATAAAGCTTGGCAATGAGAAATAAGAAAATTCTCAAGGAGGA
CGAGCTCTTGAGTGAGACCCAACAAGCTGCTTTTCACCAAATTGCAATGGAGCCTTTCGAAA
TCAATGTTCCAAAGCCCAAGAGGAGAAATGGGGTGAACTTCTCCCTAGCTGTGGTGGTCATC
TACCTGATCCTGCTCACCGCTGGCGCTGGGCTGCTGGTGGTCCAAGTTCTGAATCTGCAGGC
GCGGCTCCGGGTCCTGGAGATGTATTTCCTCAATGACACTCTGGCGGCTGAGGACAGCCCGT
CCTTCTCCTTGCTGCAGTCAGCACACCCTGGAGAACACCTGGCTCAGGGTGCATCGAGGCTG
CAAGTCCTGCAGGCCCAACTCACCTGGGTCCGCGTCAGCCATGAGCACTTGCTGCAGCGGGT
AGACAACTTCACTCAGAACCCAGGGATGTTCAGAATCAAAGGTGAACAAGGCGCCCCAGGTC
TTCAAGGTCACAAGGGGGCCATGGGCATGCCTGGTGCCCCTGGCCCGCCGGGACCACCTGCT
GAGAAGGGAGCCAAGGGGGCTATGGGACGAGATGGAGCAACAGGCCCCTCGGGACCCCAAGG
CCCACCGGGAGTCAAGGGAGAGGCGGGCCTCCAAGGACCCCAGGGTGCTCCAGGGAAGCAAG
GAGCCACTGGCACCCCAGGACCCCAAGGAGAGAAGGGCAGCAAAGGCGATGGGGGTCTCATT
GGCCCAAAAGGGGAAACTGGAACTAAGGGAGAGAAAGGAGACCTGGGTCTCCCAGGAAGCAA
AGGGGACAGGGGCATGAAAGGAGATGCAGGGGTCATGGGGCCTCCTGGAGCCCAGGGGAGTA
AAGGTGACTTCGGGAGGCCAGGCCCACCAGGTTTGGCTGGTTTTCCTGGAGCTAAAGGAGAT
CAAGGACAACCTGGACTGCAGGGTGTTCCGGGCCCTCCTGGTGCAGTGGGACACCCAGGTGC
CAAGGGTGAGCCTGGCAGTGCTGGCTCCCCTGGGCGAGCAGGACTTCCAGGGAGCCCCGGGA
GTCCAGGAGCCACAGGCCTGAAAGGAAGCAAAGGGGACACAGGACTTCAAGGACAGCAAGGA
AGAAAAGGAGAATCAGGAGTTCCAGGCCCTGCAGGTGTGAAGGGAGAACAGGGGAGCCCAGG
GCTGGCAGGTCCCAAGGGAGCCCCTGGACAAGCTGGCCAGAAGGGAGACCAGGGAGTGAAAG
GATCTTCTGGGGAGCAAGGAGTAAAGGGAGAAAAAGGTGAAAGAGGTGAAAACTCAGTGTCC
GTCAGGATTGTCGGCAGTAGTAACCGAGGCCGGGCTGAAGTTTACTACAGTGGTACCTGGGG
GACAATTTGCGATGACGAGTGGCAAAATTCTGATGCCATTGTCTTCTGCCGCATGCTGGGTT
ACTCCAAAGGAAGGGCCCTGTACAAAGTGGGAGCTGGCACTGGGCAGATCTGGCTGGATAAT
GTTCAGTGTCGGGGCACGGAGAGTACCCTGTGGAGCTGCACCAAGAATAGCTGGGGCCATCA
TGACTGCAGCCACGAGGAGGACGCAGGCGTGGAGTGCAGCGTCTGACCCGGAAACCCTTTCA
CTTCTCTGCTCCCGAGGTGTCCTCGGGCTCATATGTGGGAAGGCAGAGGATCTCTGAGGAGT
TCCCTGGGGACAACTGAGCAGCCTCTGGAGAGGGGCCATTAATAAAGCTCAACATCATTGA
```

FIGURE 232

></usr/seqdb2/sst/DNA/Dnaseqs.full/ss.DNA68886
><subunit 1 of 1, 520 aa, 1 stop
><MW: 52658, pI: 9.16, NX(S/T): 3

MRNKKILKEDELLSETQQAAFHQIAMEPFEINVPKPKRRNGVNFSLAVVVIYLILLTAGAGL
LVVQVLNLQARLRVLEMYFLNDTLAAEDSPSFSLLQSAHPGEHLAQGASRLQVLQAQLTWVR
VSHEHLLQRVDNFTQNPGMFRIKGEQGAPGLQGHKGAMGMPGAPGPPGPPAEKGAKGAMGRD
GATGPSGPQGPPGVKGEAGLQGPQGAPGKQGATGTPGPQGEKGSKGDGGLIGPKGETGTKGE
KGDLGLPGSKGDRGMKGDAGVMGPPGAQGSKGDFGRPGPPGLAGFPGAKGDQGQPGLQGVPG
PPGAVGHPGAKGEPGSAGSPGRAGLPGSPGSPGATGLKGSKGDTGLQGQQGRKGESGVPGPA
GVKGEQGSPGLAGPKGAPGQAGQKGDQGVKGSSGEQGVKGEKGERGENSVSVRIVGSSNRGR
AEVYYSGTWGTICDDEWQNSDAIVFCRMLGYSKGRALYKVGAGTGQIWLDNVQCRGTESTLW
SCTKNSWGHHDCSHEEDAGVECSV

Transmembrane domain:

amino acids 47-66 (type II)

N-glycosylation sites.

amino acids 43-47, 83-87, 136-140

Tyrosine kinase phosphorylation site.

amino acids 432-440

N-myristoylation sites.

amino acids 41-47, 178-184, 253-259, 274-280, 340-346, 346-352, 400-406, 441-447, 475-481, 490-496, 515-521

Amidation site.

amino acids 360-364

Leucine zipper pattern.

amino acids 56-78

Speract receptor repeat amino acids 422-471, 488-519

C1q domain proteins.

amino acids 151-184, 301-334, 316-349

FIGURE 233

CCCACGCGTCCGAAGGCAGACAAAGGTTCATTTGTAAAGAAGCTCCTTCCAGCACCTCCTCT
CTTCTCCTTTTGCCCAAACTCACCCAGTGAGTGTGAGCATTTAAGAAGCATCCTCTGCCAAG
ACCAAAAGGAAAGAAGAAAAAGGGCCAAAAGCCAAAATGAAACTGATGGTACTTGTTTTCAC
CATTGGGCTAACTTTGCTGCTAGGAGTTCAAGCCATGCCTGCAAATCGCCTCTCTTGCTACA
GAAAGATACTAAAAGATCACAACTGTCACAACCTTCCGGAAGGAGTAGCTGACCTGACACAG
ATTGATGTCAATGTCCAGGATCATTTCTGGGATGGGAAGGGATGTGAGATGATCTGTTACTG
CAACTTCAGCGAATTGCTCTGCTGCCCAAAAGACGTTTTCTTTGGACCAAAGATCTCTTTCG
TGATTCCTTGCAACAATCAATGAGAATCTTCATGTATTCTGGAGAACACCATTCCTGATTTC
CCACAAACTGCACTACATCAGTATAACTGCATTTCTAGTTTCTATATAGTGCAATAGAGCAT
AGATTCTATAAATTCTTACTTGTCTAAGACAAGTAAATCTGTGTTAAACAAGTAGTAATAAA
AGTTAATTCAATCTAAAAAAAAAAAAA

FIGURE 234

```
</usr/seqdb2/sst/DNA/Dnaseqs.min/ss.DNA52758
<subunit 1 of 1, 98 aa, 1 stop
<MW: 11081, pI: 6.68, NX(S/T): 1
MKLMVLVFTIGLTLLLGVQAMPANRLSCYRKILKDHNCHNLPEGVADLTQIDVNVQDHFWDG
KGCEMICYCNFSELLCCPKDVFFGPKISFVIPCNNQ
```

Important features:

Signal peptide:

amino acids 1-20

N-glycosylation site.

amino acids 72-76

Tyrosine kinase phosphorylation site.

amino acids 63-71

FIGURE 235

```
CCCACGCGTCCGCGGACGCGTGGGCTGGACCCCAGGTCTGGAGCGAATTCCAGCCTGCAGGG
CTGATAAGCGAGGCATTAGTGAGATTGAGAGAGACTTTACCCCGCCGTGGTGGTTGGAGGGC
GCGCAGTAGAGCAGCAGCACAGGCGCGGGTCCCGGGAGGCCGGCTCTGCTCGCGCCGAGATG
TGGAATCTCCTTCACGAAACCGACTCGGCTGTGGCCACCGCGCGCCGCCCGCGCTGGCTGTG
CGCTGGGGCGCTGGTGCTGGCGGGTGGCTTCTTTCTCCTCGGCTTCCTCTTCGGGTGGTTTA
TAAAATCCTCCAATGAAGCTACTAACATTACTCCAAAGCATAATATGAAAGCATTTTTGGAT
GAATTGAAAGCTGAGAACATCAAGAAGTTCTTACATAATTTTACACAGATACCACATTTAGC
AGGAACAGAACAAAACTTTCAGCTTGCAAAGCAAATTCAATCCCAGTGGAAGAATTTGGCC
TGGATTCTGTTGAGCTAGCTCATTATGATGTCCTGTTGTCCTACCCAAATAAGACTCATCCC
AACTACATCTCAATAATTAATGAAGATGGAAATGAGATTTTCAACACATCATTATTTGAACC
ACCTCCTCCAGGATATGAAAATGTTTCGGATATTGTACCACCTTTCAGTGCTTTCTCTCCTC
AAGGAATGCCAGAGGGCGATCTAGTGTATGTTAACTATGCACGAACTGAAGACTTCTTTAAA
TTGGAACGGGACATGAAAATCAATTGCTCTGGGAAAATTGTAATTGCCAGATATGGGAAAGT
TTTCAGAGGAAATAAGGTTAAAAATGCCCAGCTGGCAGGGGCCAAAGGAGTCATTCTCTACT
CCGACCCTGCTGACTACTTTGCTCCTGGGGTGAAGTCCTATCCAGACGGTTGGAATCTTCCT
GGAGGTGGTGTCCAGCGTGGAAATATCCTAAATCTGAATGGTGCAGGAGACCCTCTCACACC
AGGTTACCCAGCAAATGAATATGCTTATAGGCGTGGAATTGCAGAGGCTGTTGGTCTTCCAA
GTATTCCTGTTCATCCAATTGGATACTATGATGCACAGAAGCTCCTAGAAAAAATGGGTGGC
TCAGCACCACCAGATAGCAGCTGGAGAGGAAGTCTCAAAGTGCCCTACAATGTTGGACCTGG
CTTTACTGGAAACTTTTCTACACAAAAAGTCAAGATGCACATCCACTCTACCAATGAAGTGA
CGAGAATTTACAATGTGATAGGTACTCTCAGAGGAGCAGTGGAACCAGACAGATATGTCATT
CTGGGAGGTCACCGGGACTCATGGGTGTTTGGTGGTATTGACCCTCAGAGTGGAGCAGCTGT
TGTTCATGAAATTGTGAGGAGCTTTGGAACACTGAAAAAGGAAGGGTGGAGACCTAGAAGAA
CAATTTTGTTTGCAAGCTGGGATGCAGAAGAATTTGGTCTTCTTGGTTCTACTGAGTGGGCA
GAGGAGAATTCAAGACTCCTTCAAGAGCGTGGCGTGGCTTATATTAATGCTGACTCATCTAT
AGAAGGAAACTACACTCTGAGAGTTGATTGTACACCGCTGATGTACAGCTTGGTACACAACC
TAACAAAAGAGCTGAAAAGCCCTGATGAAGGCTTTGAAGGCAAATCTCTTTATGAAAGTTGG
ACTAAAAAAAGTCCTTCCCCAGAGTTCAGTGGCATGCCCAGGATAAGCAAATTGGGATCTGG
AAATGATTTTGAGGTGTTCTTCCAACGACTTGGAATTGCTTCAGGCAGAGCACGGTATACTA
AAAATTGGGAAACAAACAAATTCAGCGGCTATCCACTGTATCACAGTGTCTATGAAACATAT
GAGTTGGTGGAAAAGTTTTATGATCCAATGTTTAAATATCACCTCACTGTGGCCCAGGTTCG
AGGAGGGATGGTGTTTGAGCTAGCCAATTCCATAGTGCTCCCTTTTGATTGTCGAGATTATG
CTGTAGTTTTAAGAAAGTATGCTGACAAAATCTACAGTATTTCTATGAAACATCCACAGGAA
ATGAAGACATACAGTGTATCATTTGATTCACTTTTTTCTGCAGTAAAGAATTTTACAGAAAT
TGCTTCCAAGTTCAGTGAGAGACTCCAGGACTTTGACAAAAGCAACCCAATAGTATTAAGAA
TGATGAATGATCAACTCATGTTTCTGGAAAGAGCATTTATTGATCCATTAGGGTTACCAGAC
AGGCCTTTTTATAGGCATGTCATCTATGCTCCAAGCAGCCACAACAAGTATGCAGGGGAGTC
ATTCCCAGGAATTTATGATGCTCTGTTTGATATTGAAAGCAAAGTGGACCCTTCCAAGGCCT
GGGGAGAAGTGAAGAGACAGATTTATGTTGCAGCCTTCACAGTGCAGGCAGCTGCAGAGACT
TTGAGTGAAGTAGCCTAAGAGGATTTTTTAGAGAATCCGTATTGAATTTGTGTGGTATGTCA
CTCAGAAAGAATCGTAATGGGTATATTGATAAATTTTAAAATTGGTATATTTGAAATAAAGT
TGAATATTATATATAA
```

FIGURE 236

></usr/seqdb2/sst/DNA/Dnaseqs.full/ss.DNA52756
><subunit 1 of 1, 750 aa, 1 stop
><MW: 84305, pI: 6.93, NX(S/T): 10

MWNLLHETDSAVATARRPRWLCAGALVLAGGFFLLGFLFGWFIKSSNEATNITPKHNMKAFL
DELKAENIKKFLHNFTQIPHLAGTEQNFQLAKQIQSQWKEFGLDSVELAHYDVLLSYPNKTH
PNYISIINEDGNEIFNTSLFEPPPPGYENVSDIVPPFSAFSPQGMPEGDLVYVNYARTEDFF
KLERDMKINCSGKIVIARYGKVFRGNKVKNAQLAGAKGVILYSDPADYFAPGVKSYPDGWNL
PGGGVQRGNILNLNGAGDPLTPGYPANEYAYRRGIAEAVGLPSIPVHPIGYYDAQKLLEKMG
GSAPPDSSWRGSLKVPYNVGPGFTGNFSTQKVKMHIHSTNEVTRIYNVIGTLRGAVEPDRYV
ILGGHRDSWVFGGIDPQSGAAVVHEIVRSFGTLKKEGWRPRRTILFASWDAEEFGLLGSTEW
AEENSRLLQERGVAYINADSSIEGNYTLRVDCTPLMYSLVHNLTKELKSPDEGFEGKSLYES
WTKKSPSPEFSGMPRISKLGSGNDFEVFFQRLGIASGRARYTKNWETNKFSGYPLYHSVYET
YELVEKFYDPMFKYHLTVAQVRGGMVFELANSIVLPFDCRDYAVVLRKYADKIYSISMKHPQ
EMKTYSVSFDSLFSAVKNFTEIASKFSERLQDFDKSNPIVLRMMNDQLMFLERAFIDPLGLP
DRPFYRHVIYAPSSHNKYAGESFPGIYDALFDIESKVDPSKAWGEVKRQIYVAAFTVQAAAE
TLSEVA

Signal sequence:

amino acids 1-40

N-glycosylation sites.

amino acids 76-80, 121-125, 140-144, 153-157, 195-199, 336-340, 459-463, 476-480, 638-642

Tyrosine kinase phosphorylation sites.

amino acids 363-372, 605-613, 606-613, 617-626

N-myristoylation sites.

amino acids 85-91, 168-174, 252-258, 256-262, 282-288, 335-341, 360-366, 427-433, 529-535, 707-713

SECRETED AND TRANSMEMBRANE POLYPEPTIDES AND NUCLEIC ACIDS ENCODING THE SAME

RELATED APPLICATIONS

This application is a continuation of, and claims priority under 35 USC §120 to, U.S. application Ser. No. 09/918,585 filed Jul. 30, 2001, now abandoned which is a continuation of, and claims priority under 35 USC §120 to, PCT Application PCT/US00/04341 filed Feb. 18, 2000, which is a continuation-in-part of, and claims priority under 35 USC §120 to, U.S. application Ser. No. 09/380,138 filed Aug. 25, 1999, now abandoned, which is the National Stage filed under 35 USC §371 of PCT Application PCT/US99/05028 filed Mar. 8, 1999, which claims priority under 35 USC §119 to U.S. Provisional Application 60/094,651 filed Jul. 30, 1998 and to U.S. Provisional Application 60/087,106 filed May 28, 1998.

FIELD OF THE INVENTION

The present invention relates generally to the identification and isolation of novel DNA and to the recombinant production of novel polypeptides encoded by that DNA.

BACKGROUND OF THE INVENTION

Extracellular proteins play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)].

Membrane-bound proteins and receptors can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction. Efforts are being undertaken by both industry and academia to identify new, native receptor proteins. Many efforts are focused on the screening of mammalian recombinant DNA libraries to identify the coding sequences for novel receptor proteins.

We herein describe the identification and characterization of novel secreted and transmembrane polypeptides and novel nucleic acids encoding those polypeptides.

1. PRO213

Human growth arrest-specific gene 6 (gas6) encodes a protein that is expressed in a variety of different tissues and which has been reported to be highly expressed during periods of serum starvation and negatively regulated during growth induction. See Manfioletti et al., *Mol. Cell. Biol.* 13(8):4976–4985 (1993) and Stitt et al., *Cell* 80:661–670 (1995). Manfioletti et al. (1993), supra, have suggested that the gas6 protein is member of the vitamin K-dependent family of proteins, wherein the members of the latter family of proteins (which include, for example, Protein S, Protein C and Factor X) all play regulatory roles in the blood coagulation pathway. Thus, it has been suggested that gas6 may play a role in the regulation of a protease cascade relevant in growth regulation or in the blood coagulation cascade.

Given the physiological importance of the gas6 protein, efforts are currently being undertaken by both industry and academia to identify new, native proteins which are homologous to gas6. Many of these efforts are focused on the screening of mammalian recombinant DNA libraries to identify the coding sequences for novel secreted and membrane-bound receptor proteins, specifically those having homology to gas6. Examples of such screening methods and techniques are described in the literature [see, for example, Klein et al., *Proc. Natl. Acad. Sci.*, 93:7108–7113 (1996); U.S. Pat. No. 5,536,637)]. We herein describe the identification of a novel polypeptide which has homology to the gas6 polypeptide.

2. PRO274

The 7-transmembrane ("7TM") proteins or receptors, also referred to in the literature as G-protein coupled receptors, are specialized proteins designed for recognition of ligands and the subsequent signal transduction of information contained within those ligands to the machinery of the cell. The primary purpose of cell surface receptors is to discriminate appropriate ligands from the various extracellular stimuli which each cell encounters, then to activate an effector system that produces an intracellular signal, thereby controlling cellular processes. [Dohlman, H., *Ann. Rev. Biochem.*, 60:653 (1991)]. The ability of 7TM receptors to bind ligand to a recognition domain and allosterically transmit the information to an intracellular domain is a specialized feature of 7TM proteins [Kenakin, T., *Pharmacol. Rev.*, 48:413 (1996)]. The gene family which encodes the 7TM receptors or G-protein linked receptors encode receptors which recognize a large number of ligands, including but not limited to, C5a, interleukin 8 and related chemokines. Research in this area suggests that distinct signals at the cell surface feed into common pathways of cell activation. [Gerard, C. and Gerard, N., *Curr. Op. Immunol.*, 6:140 (1994), Gerard, C. and Gerard, N., *Ann. Rev. Immunol.*, 12:775 (1994)]. The superfamily of 7TM or G-protein coupled receptors contains several hundred members able to recognize various messages such as photons, ions and amino acids among others [Schwartz, T. W., et al., H., *Trends in Pharmacol. Sci.*, 17(6):213 (1996)].

[Dohlman, H., *Ann. Rev. Biochem.*, 60:653 (1991)]. [Schwartz, T. W., et al., H., *Eur. J. Pharm. Sci.*, 2:85 (1994)]. We describe herein the identification of a novel polypeptide (designated herein as PRO274) which has homology to the 7 transmembrane segment receptor proteins and the Fn54 protein.

3. PRO300

The Diff 33 protein is over-expressed in mouse testicular tumors. At present its role is unclear, however, it may play a role in cancer. Given the medical importance of understanding the physiology of cancer, efforts are currently being under taken to identify new, native proteins which are involved in cancer. We describe herein the identification of a novel polypeptide which has homology to Diff 33, designated herein as PRO300.

4. PRO284

Efforts are currently being undertaken to identify and characterize novel transmembrane proteins. We herein describe the identification and characterization of a novel transmembrane polypeptide, designated herein as PRO284.

5. PRO296

Cancerous cells often express numerous proteins that are not expressed in the corresponding normal cell type or are expressed at different levels than in the corresponding normal cell type. Many of these proteins are involved in inducing the transformation from a normal cell to a cancerous cell or in maintaining the cancer phenotype. As such, there is significant interest in identifying and characterizing proteins that are expressed in cancerous cells. We herein describe the identification and characterization of a novel polypeptide having homology to the sarcoma-amplified protein SAS, designated herein as PRO296.

6. PRO329

Immunoglobulin molecules play roles in many important mammalian physiological processes. The structure of immunoglobulin molecules has been extensively studied and it has been well documented that intact immunoglobulins possess distinct domains, one of which is the constant domain or $F_c$ region of the immunoglobulin molecule. The $F_c$ domain of an immunoglobulin, while not being directly involved in antigen recognition and binding, does mediate the ability of the immunoglobulin molecule, either uncomplexed or complexed with its respective antigen, to bind to $F_c$ receptors either circulating in the serum or on the surface of cells. The ability of an $F_c$ domain of an immunoglobulin to bind to an $F_c$ receptor molecule results in a variety of important activities, including for example, in mounting an immune response against unwanted foreign particles. As such, there is substantial interest in identifying novel $F_c$ receptor proteins and subunits thereof. We herein describe the identification and characterization of a novel polypeptide having homology to a high affinity immunoglobulin $F_c$ receptor protein, designated herein as PRO329.

7. PRO362

Colorectal carcinoma is a malignant neoplastic disease which has a high incidence in the Western world, particularly in the United States. Tumors of this type often metastasize through lymphatic and vascular channels and result in the death of some 62,000 persons in the United States annually.

Monoclonal antibody A33 (mAbA33) is a murine immunoglobulin that has undergone extensive preclinical analysis and localization studies in patients inflicted with colorectal carcinoma (Welt et al., *J. Clin. Oncol.* 8:1894–1906 (1990) and Welt et al., *J. Clin. Oncol.* 12:1561–1571 (1994)). mAbA33 has been shown to bind to an antigen found in and on the surface of normal colon cells and colon cancer cells. In carcinomas originating from the colonic mucosa, the A33 antigen is expressed homogeneously in more than 95% of the cases. The A33 antigen, however, has not been detecting in a wide range of other normal tissues, i.e., its expression appears to be rather organ specific. Therefore, the A33 antigen appears to play an important role in the induction of colorectal cancer.

Given the obvious importance of the A33 antigen in tumor cell formation and/or proliferation, there is substantial interest in identifying homologs of the A33 antigen. In this regard, we herein describe the identification and characterization of a novel polypeptide having homology to the A33 antigen protein, designated herein as PRO362.

8. PRO363

The cell surface protein HCAR is a membrane-bound protein that acts as a receptor for subgroup C of the adenoviruses and subgroup B of the coxsackieviruses. Thus, HCAR may provide a means for mediating viral infection of cells in that the presence of the HCAR receptor on the cellular surface provides a binding site for viral particles, thereby facilitating viral infection.

In light of the physiological importance of membrane-bound proteins and specifically those which serve a cell surface receptor for viruses, efforts are currently being undertaken by both industry and academia to identify new, native membrane-bound receptor proteins. Many of these efforts are focused on the screening of mammalian recombinant DNA libraries to identify the coding sequences for novel receptor proteins. We herein describe a novel membrane-bound polypeptide having homology to the cell surface protein HCAR and to various tumor antigens including A33 and carcinoembryonic antigen, designated herein as PRO363, wherein this polypeptide may be a novel cell surface virus receptor or tumor antigen.

9. PRO868

Control of cell numbers in mammals is believed to be determined, in part, by a balance between cell proliferation and cell death. One form of cell death, sometimes referred to as necrotic cell death, is typically characterized as a pathologic form of cell death resulting from some trauma or cellular injury. In contrast, there is another, "physiologic" form of cell death which usually proceeds in an orderly or controlled manner. This orderly or controlled form of cell death is often referred to as "apoptosis" [see, e.g., Barr et al., *Bio/Technology*, 12:487–493 (1994); Steller et al., *Science*, 267:1445–1449 (1995)]. Apoptotic cell death naturally occurs in many physiological processes, including embryonic development and clonal selection in the immune system [Itoh et al., *Cell*, 66:233–243 (1991)]. Decreased levels of apoptotic cell death have been associated with a variety of pathological conditions, including cancer, lupus, and herpes virus infection [Thompson, *Science*, 267:1456–1462 (1995)]. Increased levels of apoptotic cell death may be associated with a variety of other pathological conditions, including AIDS, Alzheimer's disease, Parkinson's disease, amyotrophic lateral sclerosis, multiple sclerosis, retinitis pigmentosa, cerebellar degeneration, aplastic anemia, myocardial infarction, stroke, reperfusion injury, and toxin-induced liver disease [see, Thompson, supra].

Apoptotic cell death is typically accompanied by one or more characteristic morphological and biochemical changes in cells, such as condensation of cytoplasm, loss of plasma membrane microvilli, segmentation of the nucleus, degradation of chromosomal DNA or loss of mitochondrial function. A variety of extrinsic and intrinsic signals are believed to trigger or induce such morphological and biochemical cellular changes [Raff, *Nature*, 356:397–400 (1992); Steller, supra; Sachs et al., *Blood*, 82:15 (1993)]. For instance, they can be triggered by hormonal stimuli, such as glucocorticoid hormones for immature thymocytes, as well as withdrawal of certain growth factors [Watanabe-Fukunaga et al., *Nature*, 356:314–317 (1992)]. Also, some identified oncogenes such as myc, rel, and E1A, and tumor suppressors, like p53, have been reported to have a role in inducing apoptosis. Certain chemotherapy drugs and some forms of radiation have likewise been observed to have apoptosis-inducing activity [Thompson, supra].

Various molecules, such as tumor necrosis factor-α ("TNF-α"), tumor necrosis factor-β ("TNF-β" or "lymphotoxin-α"), lymphotoxin-β ("LT-β"), CD30 ligand, CD27 ligand, CD40 ligand, OX-40 ligand, 4-1BB ligand, Apo-1 ligand (also referred to as Fas ligand or CD95 ligand), and Apo-2 ligand (also referred to as TRAIL) have been identified as members of the tumor necrosis factor ("TNF") family of cytokines [See, e.g., Gruss and Dower, *Blood*, 85:3378–3404 (1995); Pitti et al., *J. Biol. Chem.*, 271: 12687–12690 (1996); Wiley et al., *Immunity*, 3:673–682 (1995); Browning et al., *Cell*, 72:847–856 (1993); Armitage et al. *Nature*, 357:80–82 (1992), WO 97/01633 published Jan. 16, 1997; WO 97/25428 published Jul. 17, 1997]. Among these molecules, TNF-α, TNF-β, CD30 ligand, 4-1BB ligand, Apo-1 ligand, and Apo-2 ligand (TRAIL) have been reported to be involved in apoptotic cell death. Both TNF-α and TNF-β have been reported to induce apoptotic death in susceptible tumor cells [Schmid et al., *Proc. Natl. Acad. Sci.*, 83:1881 (1986); Dealtry et al., *Eur. J. Immunol.*, 17:689 (1987)]. Zheng et al. have reported that TNF-α is involved in post-stimulation apoptosis of CD8-positive T cells [Zheng et al., *Nature*, 377:348–351 (1995)]. Other investigators have reported that CD30 ligand may be involved in deletion of self-reactive T cells in the thymus [Amakawa et al., Cold Spring Harbor Laboratory Symposium on Programmed Cell Death, Abstr. No. 10, (1995)].

Mutations in the mouse Fas/Apo-1 receptor or ligand genes (called lpr and gld, respectively) have been associated with some autoimmune disorders, indicating that Apo-1 ligand may play a role in regulating the clonal deletion of self-reactive lymphocytes in the periphery [Krammer et al., *Curr. Op. Immunol.*, 6:279–289 (1994); Nagata et al., *Science*, 267:1449–1456 (1995)]. Apo-1 ligand is also reported to induce post-stimulation apoptosis in CD4-positive T lymphocytes and in B lymphocytes, and may be involved in the elimination of activated lymphocytes when their function is no longer needed [Krammer et al., supra; Nagata et al., supra]Agonist mouse monoclonal antibodies specifically binding to the Apo-1 receptor have been reported to exhibit cell killing activity that is comparable to or similar to that of TNF-α [Yonehara et al., *J. Exp. Med.*, 169:1747–1756 (1989)].

Induction of various cellular responses mediated by such TNF family cytokines is believed to be initiated by their binding to specific cell receptors. Two distinct TNF receptors of approximately 55-kDa (TNFR1) and 75-kDa (TNFR2) have been identified [Hohman et al., *J. Biol. Chem.*, 264:14927–14934 (1989); Brockhaus et al., *Proc. Natl. Acad. Sci.*, 87:3127–3131 (1990); EP 417,563, published Mar. 20, 1991] and human and mouse cDNAs corresponding to both receptor types have been isolated and characterized [Loetscher et al., *Cell*, 61:351 (1990); Schall et al., *Cell*, 61:361 (1990); Smith et al., *Science* 248: 1019–1023 (1990); Lewis et al., *Proc. Natl. Acad. Sci.*, 88:2830–2834 (1991); Goodwin et al., *Mol. Cell. Biol.*, 11:3020–3026 (1991)]. Extensive polymorphisms have been associated with both TNF receptor genes [see, e.g., Takao et al., *Immunogenetics*, 37:199–203 (1993)]. Both TNFRs share the typical structure of cell surface receptors including extracellular, transmembrane and intracellular regions. The extracellular portions of both receptors are found naturally also as soluble TNF-binding proteins [Nophar, Y. et al., *EMBO J.*, 9:3269 (1990); and Kohno, T. et al., *Proc. Natl. Acad. Sci. U.S.A.*, 87:8331 (1990)]. More recently, the cloning of recombinant soluble TNF receptors was reported by Hale et al. [*J. Cell. Biochem. Supplement* 15F, 1991, p. 113 (P424)].

The extracellular portion of type 1 and type 2 TNFRs (TNFR1 and TNFR2) contains a repetitive amino acid sequence pattern of four cysteine-rich domains (CRDs) designated 1 through 4, starting from the $NH_2$-terminus. Each CRD is about 40 amino acids long and contains 4 to 6 cysteine residues at positions which are well conserved [Schall et al., supra; Loetscher et al., supra; Smith et al., supra; Nophar et al., supra; Kohno et al., supra]. In TNFR1, the approximate boundaries of the four CRDs are as follows: CRD1-amino acids 14 to about 53; CRD2-amino acids from about 54 to about 97; CRD3-amino acids from about 98 to about 138; CRD4-amino acids from about 139 to about 167. In TNFR2, CRD1 includes amino acids 17 to about 54; CRD2-amino acids from about 55 to about 97; CRD3-amino acids from about 98 to about 140; and CRD4-amino acids from about 141 to about 179 [Banner et al., *Cell* 73:431–435 (1993)]. The potential role of the CRDs in ligand binding is also described by Banner et al., supra.

A similar repetitive pattern of CRDs exists in several other cell-surface proteins, including the p75 nerve growth factor receptor (NGFR) [Johnson et al., *Cell*, 47:545 (1986); Radeke et al., *Nature*, 325:593 (1987)], the B cell antigen CD40 [Stamenkovic et al., *EMBO J.*, 8:1403 (1989)], the T cell antigen OX40 [Mallet et al., *EMBO J.*, 9:1063 (1990)] and the Fas antigen [Yonehara et al., supra and Itoh et al., *Cell*, 66:233–243 (1991]. CRDs are also found in the soluble TNFR (sTNFR)-like T2 proteins of the Shope and myxoma poxviruses [Upton et al., *Virology*, 160:20–29 (1987); Smith et al., *Biochem. Biophys. Res. Commun.*, 176:335 (1991); Upton et al., *Virogoly*, 184:370 (1991)]. Optimal alignment of these sequences indicates that the positions of the cysteine residues are well conserved. These receptors are sometimes collectively referred to as members of the TNF/NGF receptor superfamily. Recent studies on p75NGFR showed that the deletion of CRD1 [Welcher, A. A. et al., *Proc. Natl. Acad. Sci. USA*, 88:159–163 (1991)] or a 5-amino acid insertion in this domain [Yan, H. and Chao, M. V., *J. Biol. Chem.*, 266:12099–12104 (1991)] had little or no effect on NGF binding [Yan, H. and Chao, M. V., supra]. p75 NGFR contains a proline-rich stretch of about 60 amino acids, between its CRD4 and transmembrane region, which is not involved in NGF binding [Peetre, C. et al., *Eur. J. Hematol.*, 41:414–419 (1988); Seckinger, P. et al., *J. Biol. Chem.*, 264:11966–11973 (1989); Yan, H. and Chao, M. V., supra]. A similar proline-rich region is found in TNFR2 but not in TNFR1.

The TNF family ligands identified to date, with the exception of lymphotoxin-α, are type II transmembrane proteins, whose C-terminus is extracellular. In contrast, most receptors in the TNF receptor (TNFR) family identified to date are type I transmembrane proteins. In both the TNF ligand and receptor families, however, homology identified between family members has been found mainly in the extracellular domain ("ECD"). Several of the TNF family cytokines, including TNF-α, Apo-1 ligand and CD40 ligand, are cleaved proteolytically at the cell surface; the resulting protein in each case typically forms a homotrimeric molecule that functions as a soluble cytokine. TNF receptor family proteins are also usually cleaved proteolytically to release soluble receptor ECDs that can function as inhibitors of the cognate cytokines.

Recently, other members of the TNFR family have been identified. Such newly identified members of the TNFR family include CAR1, HVEM and osteoprotegerin (OPG) [Brojatsch et al., *Cell*, 87:845–855 (1996); Montgomery et al., *Cell*, 87:427–436 (1996); Marsters et al., *J. Biol. Chem.*, 272:14029–14032 (1997); Simonet et al., *Cell*, 89:309–319 (1997)]. Unlike other known TNFR-like molecules, Simonet et al., supra, report that OPG contains no hydrophobic transmembrane-spanning sequence.

Moreover, a new member of the TNF/NGF receptor family has been identified in mouse, a receptor referred to as "GITR" for "glucocorticoid-induced tumor necrosis factor receptor family-related gene" [Nocentini et al., *Proc. Natl. Acad. Sci. USA* 94:6216–6221 (1997)]. The mouse GITR receptor is a 228 amino acid type I transmembrane protein that is expressed in normal mouse T lymphocytes from thymus, spleen and lymph nodes. Expression of the mouse GITR receptor was induced in T lymphocytes upon activation with anti-CD3 antibodies, Con A or phorbol 12-myristate 13-acetate. It was speculated by the authors that the mouse GITR receptor was involved in the regulation of T cell receptor-mediated cell death.

In Marsters et al., *Curr. Biol.*, 6:750 (1996), investigators describe a full length native sequence human polypeptide, called Apo-3, which exhibits similarity to the TNFR family in its extracellular cysteine-rich repeats and resembles TNFR1 and CD95 in that it contains a cytoplasmic death domain sequence [see also Marsters et al., *Curr. Biol.*, 6:1669 (1996)]. Apo-3 has also been referred to by other investigators as DR3, ws1-1 and TRAMP [Chinnaiyan et al., *Science*, 274:990 (1996); Kitson et al., *Nature*, 384:372 (1996); Bodmer et al., *Immunity*, 6:79 (1997)].

Pan et al. have disclosed another TNF receptor family member referred to as "DR4" [Pan et al., *Science*, 276: 111–113 (1997)]. The DR4 was reported to contain a cytoplasmic death domain capable of engaging the cell suicide apparatus. Pan et al. disclose that DR4 is believed to be a receptor for the ligand known as Apo-2 ligand or TRAIL.

In Sheridan et al., *Science*, 277:818–821 (1997) and Pan et al., *Science*, 277:815–818 (1997), another molecule believed to be a receptor for the Apo-2 ligand (TRAIL) is described. That molecule is referred to as DR5 (it has also been alternatively referred to as Apo-2). Like DR4, DR5 is reported to contain a cytoplasmic death domain and be capable of signaling apoptosis.

In Sheridan et al., supra, a receptor called DcR1 (or alternatively, Apo-2DcR) is disclosed as being a potential decoy receptor for Apo-2 ligand (TRAIL). Sheridan et al. report that DcR1can inhibit Apo-2 ligand function in vitro. See also, Pan et al., supra, for disclosure on the decoy receptor referred to as TRID.

For a review of the TNF family of cytokines and their receptors, see Gruss and Dower, supra.

As presently understood, the cell death program contains at least three important elements—activators, inhibitors, and effectors; in *C. elegans*, these elements are encoded respectively by three genes, Ced-4, Ced-9 and Ced-3 [Steller, *Science*, 267:1445 (1995); Chinnaiyan et al., *Science*, 275: 1122–1126(1997); Wang et al., *Cell*, 90:1–20 (1997)]. Two of the TNFR family members, TNFR1 and Fas/Apol (CD95), can activate apoptotic cell death [Chinniaiyan and Dixit, *Current Biology*, 6:555–562 (1996); Fraser and Evan, *Cell*; 85:781–784 (1996)]. TNFR1 is also known to mediate activation of the transcription factor, NF-κB [Tartaglia et al., *Cell*, 74:845–853 (1993); Hsu et al., *Cell* 84:299–308 (1996)]. In addition to some ECD homology, these two receptors share homology in their intracellular domain (ICD) in an oligomerization interface known as the death domain [Tartaglia et al., supra; Nagata, *Cell*, 88:355 (1997)]. Death domains are also found in several metazoan proteins that regulate apoptosis, namely, the *Drosophila* protein, Reaper, and the mammalian proteins referred to as FADD/MORT1, TRADD, and RIP [Cleaveland and Ihle, *Cell* 81:479–482 (1995)].

Upon ligand binding and receptor clustering, TNFR1 and CD95 are believed to recruit FADD into a death-inducing signalling complex. CD95 purportedly binds FADD directly, while TNFR1 binds FADD indirectly via TRADD [Chinnaiyan et al., *Cell*, 81:505–512 (1995); Boldin et al., *J. Biol. Chem.*, 270:387–391 (1995); Hsu et al., supra; Chinnaiyan et al., *J. Biol. Chem.*, 271:4961–4965 (1996)]. It has been reported that FADD serves as an adaptor protein which recruits the Ced-3-related protease, MACHα/FLICE (caspase 8), into the death signalling complex [Boldin et al., *Cell*, 85:803–815 (1996); Muzio et al., *Cell*, 85:817–827 (1996)]. MACHα/FLICE appears to be the trigger that sets off a cascade of apoptotic proteases, including the interleukin-1β converting enzyme (ICE) and CPP32/Yama, which may execute some critical aspects of the cell death programme [Fraser and Evan, supra].

It was recently disclosed that programmed cell death involves the activity of members of a family of cysteine proteases related to the *C. elegans* cell death gene, ced-3, and to the mammalian IL-1-converting enzyme, ICE. The activity of the ICE and CPP32/Yama proteases can be inhibited by the product of the cowpox virus gene, crmA [Ray et al., *Cell*, 69:597–604 (1992); Tewari et al., *Cell*, 81:801–809 (1995)]. Recent studies show that CrmA can inhibit TNFR1- and CD95-induced cell death [Enari et al., *Nature*, 375:78–81 (1995); Tewari et al., *J. Biol. Chem.*, 270:3255–3260 (1995)].

As reviewed recently by Tewari et al., TNFR1, TNFR2 and CD40 modulate the expression of proinflammatory and costimulatory cytokines, cytokine receptors, and cell adhesion molecules through activation of the transcription factor, NF-κB [Tewari et al., *Curr. Op. Genet. Develop.*, 6:39–44 (1996)]. NF-κB is the prototype of a family of dimeric transcription factors whose subunits contain conserved Rel regions [Verma et al., *Genes Develop.*, 9:2723–2735 (1996); Baldwin, *Ann. Rev. Immunol.*, 14:649–681 (1996)]. In its latent form, NF-κB is complexed with members of the IκB inhibitor family; upon inactivation of the IκB in response to certain stimuli, released NF-κB translocates to the nucleus where it binds to specific DNA sequences and activates gene transcription.

10. PRO382

Proteases are enzymatic proteins which are involved in a large number of very important biological processes in mammalian and non-mammalian organisms. Numerous different protease enzymes from a variety of different mammalian and non-mammalian organisms have been both identified and characterized, including the serine proteases which exhibit specific activity toward various serine-containing proteins. The mammalian protease enzymes play important roles in biological processes such as, for example, protein digestion, activation, inactivation, or modulation of peptide hormone activity, and alteration of the physical properties of proteins and enzymes.

In light of the important physiological roles played by protease enzymes, efforts are currently being undertaken by both industry and academia to identify new, native protease homologs. Many of these efforts are focused on the screening of mammalian recombinant DNA libraries to identify the coding sequences for novel membrane-bound receptor proteins. Examples of screening methods and techniques are described in the literature [see, for example, Klein et al., *Proc. Natl. Acad. Sci.*, 93:7108–7113 (1996); U.S. Pat. No. 5,536,637)]. We herein describe the identification of novel polypeptides having homology to serine protease enzymes, designated herein as PRO382 polypeptides.

11. PRO545

The ADAM (A Disintegrin And Metalloprotease) family of proteins of which meltrin is a member may have an important role in cell interactions and in modulating cellular responses. [see, for example, Gilpin et al., *J. Biol. Chem.*, 273(1):157–166(1998)]. The ADAM proteins have been implicated incarcinogenesis. Meltrin-α (ADAM12) is a myoblast gene product reported to be required for cell fusion. [Harris et al., *J. Cell. Biochem.*, 67(1): 136–142 (1997), Yagami-Hiromasa et al., *Nature*, 377:652–656 (1995)]. The meltrins contain disintegrin and metalloprotease domains and are implicated in cell adhesive events involved in development, through the integrin-binding disintegrin domain, but also have an anti-adhesive function through a zinc-dependent metalloprotease domain. [Alfandari et al., *Devel. Biol.*, 182(2):314–330 (1997)]. Given the medical importance of cell fusion and modulation of cellular responses in carcinogenesis and other disease mechanisms, efforts are currently being under taken to identify new, native proteins which are involved in cell fusion and modulation of cellular responses. We describe herein the identification of a novel polypeptide which has homology to a meltrin, designated herein as PRO545.

12. PRO617

CD24 is a protein that is associated with the cell surface of a variety of different cells of the mammalian immune system, including for example, neutrophils, monocytes and some lymphocytes, for example, B lymphocytes. CD24 has been shown to be a ligand for the platelet-associated surface glycoprotein P-selectin (also known as granule membrane protein-140 or GMP-140), a glycoprotein that is constitutively synthesized in both platelets and endothelial cells and becomes exposed on the surface of platelets when those cells become activated. In this way, P-selectin mediates the calcium-dependent adhesion of activated platelets and endothelial cells to the various cells of the immune system that express one or more ligands for the P-selectin molecule, particularly CD24. This mechanism allows for recruitment of immune system cells to locations where they are most needed, for example, sites of injury. Thus, there is substantial interest in identifying novel polypeptides that exhibit homology to the cell surface antigens of the immune system cells. We herein describe the identification and characterization of a novel polypeptide having homology to the CD24 protein, wherein that novel polypeptide is herein designated PRO617.

13. PRO700

Protein-disulfide isomerase (PDI) is a catalyst of disulfide formation and isomerization during protein folding. It has two catalytic sites housed in two domains homologous to thioredoxin, one near the N terminus and the other near the C terminus. [See for example, Gilbert H F, *J. Biol. Chem.*, 47:29399–29402 (1997), Mayfield K J, *Science*, 278:1954–1957 (1997) and Puig et al., *J. Biol. Chem.*, 52:32988–32994 (1997)]. PDI is useful for formation of natural type disulfide bonds in a protein which is produced in aprokaryotic cell. (See also, U.S. Pat. Nos. 5,700,659 and 5,700,678).

Thus, PDI and molecules related thereto are of interest, particularly for ability to catalyze the formation of disulfide bonds. Moreover, these molecules are generally of interest in the study of redox reactions and related processes. PDI and related molecules are further described in Darby, et al., *Biochemistry* 34, 11725–11735 (1995). We herein describe the identification and characterization of novel polypeptides having homology to protein disulfide isomerase, designated herein as PRO700 polypeptides.

14. PRO702

Conglutinin is a bovine serum protein that was originally described as a vertebrate lectin protein and which belongs to the family of C-type lectins that have four characteristic domains, (1) an N-terminal cysteine-rich domain, (2) a collagen-like domain, (3) a neck domain and (4) a carbohydrate recognition domain (CRD). Recent reports have demonstrated that bovine conglutinin can inhibit hemagglutination by influenza A viruses as a result of their lectin properties (Eda et al., *Biochem. J.* 316:43–48 (1996)). It has also been suggested that lectins such as conglutinin can function as immunoglobulin-independent defense molecules due to complement-mediated mechanisms. Thus, conglutinin has been shown to be useful for purifying immune complexes in vitro and for removing circulating immune complexes from patients plasma in vivo (Lim et al., *Biochem. Biophys. Res. Commun.* 218:260–266 (1996)). We herein describe the identification and characterization of a novel polypeptide having homology to the conglutin protein, designated herein as PRO702.

15. PRO703

Very-long-chain acyl-CoA synthetase ("VLCAS") is a long-chain fatty acid transport protein which is active in the cellular transport of long and very long chain fatty acids. [see for example, Uchida et al., *J Biochem* (Tokyo) 119(3): 565–571 (1996) and Uchiyama et al., *J Biol Chem* 271(48): 30360–30365 (1996). Given the biological importance of fatty acid transport mechanisms, efforts are currently being under taken to identify new, native proteins which are involved in fatty acid transport. We describe herein the identification of a novel polypeptide which has homology to VLCAS, designated herein as PRO703.

16. PRO705

The glypicans are a family of glycosylphosphatidylinositol (GPI)-anchored proteoglycans that, by virtue of their cell surface localization and possession of heparin sulfate chains, may regulate the responses of cells to numerous heparin-binding growth factors, cell adhesion molecules and extracellular matrix components. Mutations in one glypican protein cause of syndrome of human birth defects, suggesting that the glypicans may play an important role in development (Litwack et al., *Dev. Dyn.* 211:72–87 (1998)). Also, since the glypicans may interact with the various extracellular matrices, they may also play important roles in wound healing (McGrath et al., *Pathol.* 183:251–252 (1997)). Furthermore, since glypicans are expressed in neurons and glioma cells, they may also play an important role in the regulation of cell division and survival of cells of the nervous system (Liang et al., *J. Cell. Biol.* 139:851–864 (1997)). It is evident, therefore, that the glypicans are an extremely important family of proteoglycans. There is, therefore, substantial interest in identifying novel polypeptides having homology to members of the glypican family. We herein describe the identification and characterization of a novel polypeptide having homology to K-glypican, designated herein as PRO705.

17. PRO708

Aryl sulfatases are enzymes that exist in a number of different isoforms, including aryl sulfatase A (ASA), aryl sulfatase B (ASB) and aryl sulfatase C (ASC), and that function to hydrolyze a variety of different aromatic sulfates. Aryl sulfatases have been isolated from a variety of different animal tissues and microbial sources and their structures and functions have been extensively studied (see, e.g., Nichol and Roy, *J. Biochem.* 55:643–651 (1964)). ASA deficiency has been reported to be associated with metachromatic leukodystrophy (MLD) (Giles et al., *Prenat. Diagn.* 7(4): 245–252 (1987) and Herska et al., *Am. J. Med. Genet.* 26(3):629–635 (1987)). Additionally, other groups have reported that aryl sulfatases have been found in high levels in natural killer cells of the immune system and have hypothesized a possible role for these enzymes in NK cell-mediated cellular lysis (see, e.g., Zucker-Franklin et al., *Proc. Natl. Acad. Sci. USA* 80(22):6977–6981 (1983)). Given the obvious physiological importance of the aryl sulfatase enzymes, there is a substantial interest in identifying novel aryl sulfatase homolog polypeptides. We herein describe the identification and characterization of novel polypeptides having homology to the aryl sulfatases, wherein these novel polypeptides are herein designated PRO708 polypeptides.

18. PRO320

Fibulin-1 is a cysteine-rich, calcium-binding extracellular matrix (ECM) component of basement membranes and connective tissue elastic fibers and plasma protein, which has four isoforms, A–D, derived from alternative splicing. Fibulin-1 is a modular glycoprotein with amino-terminal anaphlatoxin-like modules followed by nine epidermal growth factor (EGF)-like modules and, depending on alternative splicing, four possible carboxyl termini. Fibulin-2 is a novel extracellular matrix protein frequently found in close association with microfibrils containing either fibronectin or fibrillin. There are multiple formis of fibulin-1 that differ in their C-terminal regions that are produced through the process of alternative splicing of their precursor RNA. [see for example Tran et al., *Matrix Biol* 15(7):479–493 (1997).]

Northern and Western blotting analysis of 16 cell lines established from tumors formed in athymic mice and malignant cell lines derived from patients indicate that low expression of fibulin-1D plays a role in tumor formation and invasion. [Qing et al., *Oncogene*, 18:2159–2168 (1997)]. Ovarian-cancer cells are characterized by their ability to invade freely the peritoneal cavity. It has been demonstrated that estradiol stimulates the proliferation of estrogen-receptor (ER)-positive ovarian-cancer cells, as well as expression of fibulin-1. Studies on the effect of fibulin-1 on motility of the MDA-MB231 breast-cancer cell line, indicated inhibition of haptotactic migration of MDA-MB231 cells, and the authors concluded that fibulin-1 can inhibit cancer cell motility in vitro and therefore has the potential to inhibit tumor invasion. [Hayashido et al., *Int J Cancer*, 75(4): 654–658 (1998)]

Thus, fibulin, and molecules related thereto are of interest, particularly for the use of preventing cancer. Moreover, these molecules are generally of interest in the study of connective tissue and attachment molecules and related mechanisms. Fibulin and related molecules are further described in Adams, et al., *J. Mol. Biol.*, 272(2):226–36 (1997); Kielty and Shuttleworth, *Microsc. Res. Tech.*, 38(4): 413–27 (1997); and *Child, J. Card. Surg.* 12(2Supp.):131–5 (1997).

We herein describe the identification and characterization of novel polypeptides having homology to fibulin, designated herein as PRO320 polypeptides.

19. PRO324

Oxidoreductases are enzymes that catalyze a reaction in which two molecules of a compound interact so that one molecule is oxidized and the other is reduced, with a molecule of water entering the reaction. There are many different types of oxidoreductase enzymes that play very important physiological roles in the mammalian organism. Some of the most important oxidoreductases include, for example, lyases, lactases, cholesterol oxidases, and the like. These enzymes play roles in such essential processes as digestion, signal transduction, maintenance of ionic homeostasis, and the like. As such, given that oxidoreductase enzymes find various essential uses in the mammalian organism, there is a substantial interest in identifying novel oxidoreductase enzyme homologs. We herein describe the identification and characterization of a novel polypeptide having homology to oxidoreductases, designated herein as PRO324.

20. PRO351

Prostasin is a novel human serine proteinase purified from human seminal fluid. Immunohistochemical localization reveals that prostasin is present in epithelial cells and ducts of the prostate gland. The cDNA for prostasin has been cloned and characterized. Southern blot analysis, following a reverse transcription polymerase chain reaction, indicates that prostasin mRNA is expressed in prostate, liver, salivary gland, kidney, lung, pancreas, colon, bronchus, renal proximal tubular cells, and prostate carcinoma LNCaP cells. Cellular localization of prostasin mRNA was identified within epithelial cells of the human prostate gland by in situ hybridization histochemistry. [See for example, Yu et al., *J Biol Chem.* (1994) 269(29): 18843–18848, and Yu et al., *J Biol Chem.* (1994) 270(22):13483–13489].

Thus, prostasin, and molecules related thereto are of interest, particularly for the study, diagnosis and treatment of medical conditions involving the prostate. Prostasin and related molecules are further described in Yu et al., *Genomics* (1996) 32(3):334–340. We herein describe the identification and characterization of novel polypeptides having homology to prostasin, designated herein as PRO351 polypeptides.

21. PRO352

Butyrophilin is a milk glycoprotein that constitutes more than 40% of the total protein associated with the fat globule membrane in mammalian milk. Expression of butyrophilin mRNA has been shown to correlate with the onset of milk fat production toward the end pregnancy and is maintained throughout lactation. Butyrophilin has been identified in bovine, murine and human (see Taylor et al., *Biochim. Biophys. Acta* 1306:1–4 (1996), Ishii et al., *Biochim. Biophys. Acta* 1245:285–292 (1995), Mather et al., *J. Dairy Sci.* 76:3832–3850 (1993) and Banghart et al., *J. Biol. Chem.* 273:4171–4179 (1998)) and is a type I transmembrane protein that is incorporated into the fat globulin membrane. It has been suggested that butyrophilin may play a role as the principle scaffold for the assembly of a complex with xanthine dehydrogenaseloxidase and other proteins that function in the budding and release of milk-fat globules from the apical surface during lactation (Banghart et al., supra).

Given that butyrophilin plays an obviously important role in mammalian milk production, there is substantial interest in identifying novel butyrophilin homologs. We herein describe the identification and characterization of a novel polypeptide having homology to butyrophilin, designated herein as PRO352.

22. PRO381

The immunophilins are a family of proteins that function as receptors for immunosuppressant drugs, such as cyclosporin A, FK506, and rapamycin. The immunophilins occur in two separate classes, (1) the FK506-binding proteins (FKBPs), which bind to FK506 and rapamycin, and (2) the cyclophilins, which bind to cyclosporin A. With regard to the FK506-binding proteins, it has been reported that the FK506/FKBP complex functions to inhibit the activity of the serine/threonine protein phosphatase 2B (calcineurin), thereby providing immunosuppressant activity (Gold, *Mol. Neurobiol.* 15:285–306 (1997)). It has also been reported that the FKBP immunophilins are found in the mammalian nervous system and may be involved in axonal regeneration in the central nervous system through a mechanism that is independent of the process by which immunosuppression is achieved (Gold, supra). Thus, there is substantial interest in identifying novel polypeptides having homology to the FKBP immunophilins. We herein describe the identification and characterization of a novel polypeptide having homology to an FKBP immunophilin protein, designated herein as PRO381.

23. PRO386

Mammalian cell membranes perform very important functions relating to the structural integrity and activity of various cells and tissues. Of particular interest in membrane physiology is the study of transmembrane ion channels which act to directly control a variety of physiological, pharmacological and cellular processes. Numerous ion channels have been identified including calcium (Ca), sodium (Na) and potassium (K) channels, each of which have been analyzed in detail to determine their roles in physiological processes in vertebrate and insect cells.

One type of cell membrane-associated ion channel, the sodium channel, plays an extremely important role in a cell's ability to maintain ionic homeostasis as well as transmit intracellular and extracellular signals. Voltage-gated sodium channels in brain neurons have been shown to be complexes of a pore-forming alpha unit with smaller beta-1 and beta-2 subunits (Isom et al., *Cell* 83:433–442 (1995)). Given the obvious importance of sodium channels in cellular homeostasis and other important physiological f unctions, there is a significant interest in identifying novel polypeptides having homology to sodium channel subunits. We herein describe the identification and characterization of a novel polypeptide having homology to the beta-2 subunit of the rat sodium channel, designated herein as PRO386.

24. PRO540

Lecithin-cholesterol acyltransferase ("LCAT"), also known as phosphatidylcholine-sterol acyltransferase is a key enzyme in the intravascular metabolism of high density lipoproteins, specifically in the process of cholesterol metabolism. [see, for example, Brousseau et al., *J. Lipid Res.*, 38(12):2537–2547 (1997), Hill et al., *Biochem. J.*, 294:879–884 (1993), and Drayna et al., *Nature* 327 (6123): 632–634 (1987)]. Given the medical importance of lipid metabolism, efforts are currently being under taken to identify new, native proteins which are involved in lipid transport. We describe herein the identification of a novel polypeptide which has homology to LCAT, designated herein as PRO540.

25. PRO615

Synaptogyrin is a synaptic vesicle protein that is uniformly distributed in the nervous system. The cDNA encoding synaptogyrin has been cloned and sequenced and the sequence predicts a protein with a molecular mass of 25,900 D with four membrane-spanning domains. Synaptogyrin has been implicated in membrane traffic to and from the plasma membrane. Stenius et al., *J. Cell. Biol.* 131(6–2): 1801–1809 (1995). In addition, a novel isoform of synaptogyrin called cellugyrin exhibits sequence identity with synaptogyrin. In rat tissues, cellugyrin and synaptogyrins are expressed in mirror image patterns. Cellugyrin is ubiquitously present in all tissues tested with the lowest levels in brain tissue, whereas synaptogyrin protein is only detectable in brain. In rat tissues, cellugyrin and synaptogyrins are expressed in mirror image patterns. The synaptic vesicle protein synaptogyrin may be a specialized version of a ubiquitous protein, cellugyrin, with the two proteins sharing structural similarity but differing in localization. This finding supports the emerging concept of synaptic vesicles as the simplified and specialized form of a generic trafficking organelle. [Janz et al., *J. Biol. Chem.* 273(5):2851–2857 (1998)]. The sequence for cellugyrin derived from the Norway rat, *Rattus norvegicus* has been deposited in the Genbank database on 23Dec. 1997, designated accession number AF039085. See also, Janz et al., *J. Biol. Chem.* 273 (1998), in press.

Given the medical importance of synaptic transmission, efforts are currently being under taken to identify new, native proteins that may be part of a simplified and specialized generic trafficking organelle in the form of synaptic vesicles. We describe herein the identification of a novel polypeptide which has homology to synaptogyrin, designated herein as PRO615.

26. PRO618

Enteropeptidase is a key enzyme in the intestinal digestion cascade specifically cleaves the acidic propeptide from trypsinogen to yield active trypsin. This cleavage initiates a cascade of proteolytic reactions leading to the activation of many pancreatic zymogens.

See, for example, Matsushima et al., *J. Biol. Chem.* 269(31):19976–19982 (1994), Kitamoto et al., *Proc. Nat.*

*Acad. Sci.,* 91(16):7588–7592 (1994). Enterokinase (enteropeptidase) is a related to mammalian serine proteases involved indigestion, coagulation, and fibrinolysis. LaVallie et al., *J Biol Chem.,* 268(31):23311–23317 (1993).

Given the medical importance of digestive processes, efforts are currently being under taken to identify new, native proteins that may be involved in digestion, coagulation, and fibrinolysis. We describe herein the identification of a novel polypeptide which has homology to enteropeptidase, designated herein as PRO618.

27. PRO719

Lipoprotein lipase is a key enzyme that mediates the hydrolysis of triglycerides and phospholipids present in circulating plasma lipoproteins (Dugi et al., *J. Biol. Chem.* 270:25396–25401 (1995)). Moreover, lipoprotein lipase has been shown to mediate the uptake of lipoproteins into cells, wherein cellular uptake of lipoproteins is initiated by binding of lipoprotein lipase to cell surface proteoglycans and to the low density lipoprotein (LDL) receptor-related protein (Krapp et al., *J. Lipid Res.* 36:2362–2373 (1995)). Thus, it is clear that lipoprotein lipase plays an extremely important role in lipoprotein and cholesterol metabolism. There is, therefore, substantial interest in identifying novel polypeptides that share sequence homology and/or biological activity with lipoprotein lipase. We herein describe the identification and characterization of a novel polypeptide having sequence homology to lipoprotein lipase H, designated herein as PRO719.

28. PRO724

The low density lipoprotein (LDL) receptor is a membrane-bound protein that plays a key role in cholesterol homeostasis, mediating cellular uptake of lipoprotein particles by high affinity binding to its ligands, apolipoprotein (apo) B-100 and apoE. The ligand-binding domain of the LDL receptor contains 7 cysteine-rich repeats of approximately 40 amino acids, wherein each repeat contains 6 cysteines, which form 3 intra-repeat disulfide bonds. These unique structural features provide the LDL receptor with its ability to specifically interact with apo B-100 and apoE, thereby allowing for transport of these lipoprotein particles across cellular membranes and metabolism of their components. Soluble fragments containing the extracellular domain of the LDL receptor have been shown to retain the ability to interact with its specific lipoprotein ligands (Simmons et al., *J. Biol. Chem.* 272:25531–25536 (1997)). Thus, it is clear that the LDL receptor is intimately involved in important physiological activities related to cholesterol metabolism. As such, there is substantial interest in identifying novel LDL receptor homolog proteins. We herein describe the identification and characterization of a novel polypeptide having homology to the human LDL receptor protein, designated herein as PRO724.

29. PRO772

Expression of the human gene A4 is enriched in the colonic epithelium and is transcriptionally activated on differentiation of colonic epithelial cells in vitro (Oliva et al., *Arch. Biochem. Biophys.* 302:183–192 (1993) and Oliva et al., *Am. J. Physiol.* 272:C957–C965 (1997)). A4 cDNA contains an open reading frame that predicts a polypeptide of approximately 17 kilodaltons in size. Hydropathy analysis of the A4 protein revealed four putative membrane-spanning alpha-helices. Inmunocytochemical studies of cells expressing A4 protein indicated that expression is localized to the endoplasmic reticulum. The four membrane-spanning domains and the biophysical characteristics of the A4 protein suggest that it belongs to a family of integral membrane proteins called proteolipids, some of which multimerize to form ion channels. In fact, preliminary evidence has suggested that A4 may itself multimerize and take on the properties of an ion channel (Oliva et al., *Am. J. Physiol.* 272:C957–C965 (1997)). Given the importance of ion channels in maintaining cellular homeostasis, there is a significant interest in identifying novel polypeptides having homology to known and putative ion channels. We herein describe the identification and characterization of a novel polypeptide having homology to the putative ion channel protein, A4, designated herein as PRO772.

30. PRO852

Proteases are enzymatic proteins which are involved in a large number of very important biological processes in mammalian and non-mammalian organisms. Numerous different protease enzymes from a variety of different mammalian and non-mammalian organisms have been both identified and characterized. The mammalian protease enzymes play important roles in many different biological processes including, for example, protein digestion, activation, inactivation, or modulation of peptide hormone activity, and alteration of the physical properties of proteins and enzymes.

In light of the important physiological roles played by protease enzymes, efforts are currently being undertaken by both industry and academia to identify new, native protease homologs. Many of these efforts are focused on the screening of mammalian recombinant DNA libraries to identify the coding sequences for novel secreted and membrane-bound receptor proteins. Examples of screening methods and techniques are described in the literature [see, for example, Klein et al., *Proc. Natl. Acad. Sci.,* 93:7108–7113 (1996); U.S. Pat. No. 5,536,637)]. We herein describe the identification of novel polypeptides having homology to various protease enzymes, designated herein as PRO852 polypeptides.

31. PRO853

Studies have reported that the redox state of the cell is an important determinant of the fate of the cell. Furthermore, reactive oxygen species have been reported to be cytotoxic, causing inflammatory disease, including tissue necrosis, organ failure, atherosclerosis, infertility, birth defects, premature aging, mutations and malignancy. Thus, the control of oxidation and reduction is important for a number of reasons, including the control and prevention of strokes, heart attacks, oxidative stress, hypertension and may be associated with the development of malignancies. The levels of antioxidant enzymes, such as reductases, which catalyze the conversion of reactive oxygen species to water have been shown to be low in cancer cells. In particular, malignant prostate epithelium may have lowered expression of such antioxidant enzymes [Baker et., *Prostate* 32(4):229–233 (1997)]. In this regard, reductases, are of interest. In addition, the transcription factors, NF-kappa B and AP-1, are known to be regulated by redox state and to affect the expression of a large variety of genes thought to be involved in the pathogenesis of AIDS, cancer, atherosclerosis and diabetic complications. Publications further describing this subject matter include Engman et al., *Anticancer Res. (Greece),* 17:4599–4605 (1997), Kelsey, et al., *Br. J. Cancer,* 76(7):852–4 (1997); Friedrich and Weiss, *J. Theor. Biol.,* 187(4):529–40 (1997) and Pieulle, et al., *J. Bacteriol.,* 179(18):5684–92 (1997). Given the physiological importance of redox reactions in vivo, efforts are currently being under taken to identify new, native proteins which are involved in redox reactions. We describe herein the identification of a novel prostate specific polypeptide which has sequence similarity to reductase, designated herein as PRO853.

32. PRO860

Neurofascin is a member of the L1 subgroup of the cellular adhesion molecule ("CAM") family of nervous system adhesion molecules and is involved in cellular aggregation. Cell-cell recognition and patterning of cell contacts have a critical role in mediating reversible assembly of a wide variety or transcellular complexes in the nervous system. Cell interactions may be regulated through modulation of ankyrin binding to neurofascin. See, for example, Tuvia et al., *Proc. Nat Acad. Sci.*, 94(24) 12957–12962 (1997). Neurofascin has been described as a member of the L1 subgroup of the immunoglobulin superfamily implicated in neurite extension during embryonic development for which numerous isoforms have been detected at various stages of development. See also Hassel et al., *J. Biol. Chem.*, 272(45) 28742–28749 (1997), Grumet., *Cell. Tissue Res.* 290(2) 423–428 (1997), Garver et al., *J. Cell. Biol.*, 137: 703–714 (1997), and Lambert et al., *J. Neurosci.*, 17:7025–7–36 (1997).

Given the physiological importance of cellular adhesion molecules and development of the nervous system in vivo, efforts are currently being under taken to identify new, native proteins which are involved in regulation of cellular interactions in the nervous system. We describe herein the identification and characterization of a novel polypeptide which has sequence similarity to neurofascin, designated herein as PRO860.

33. PRO846

The CMRF35 monoclonal antibody was used to identify a cell membrane antigen, designated CMRF35, which is present on the surface of monocytes, neutrophils, a proportion of peripheral blood T and B lymphocytes and lymphocytic cell lines. The CMRF35 cDNA encodes a novel integral membrane glycoprotein member of the immunoglobulin (g) gene superfamily. The molecule comprises (a) a single extracellular Ig variable domain remarkably similar to the Fc receptor for polymeric IgA and IgM, (b) a membrane-proximal domain containing a high proportion of proline, serine and threonine residues that was predicted to be heavily O-glycosylated, (c) an unusual transmembrane anchor that contained a glutamic acid and a proline residue and (d) a short cytoplasmic tail. Transcripts encoding the CMRF35 protein have been detected in early monocytic cell lines, in peripheral blood T cells and in some B lymphoblastoid cell lines, confirming the results of immunocytological staining. Jackson et al., *Eur. J. Imunol.* 22(5):1157–1163 (1992). CMRF-35 molecules are differentially expressed in hematopoietic cells, and the expression of the antigen was shown to be markedly influenced by stimulation with mitogens and cytokines. See, for example, Clark et al., *Exp. Hematol.* 25(8):759 (1997), Daish et al., *Immunol.* 79(1):55–63 (1993), and Clark et al., *Tissue Antigens* 48:461 (1996).

Given the physiological importance of the immune system and antigens associated with various immune system cells, efforts are currently being under taken to identify new, native proteins which are expressed on various cells of the immune system. We describe herein the identification of a novel polypeptide which has sequence similarity to CMRF35, designated herein as PRO846.

34. PRO862

Lysozyme is a protein which is widely distributed in several human tissues and secretions including milk, tears and saliva. It has been demonstrated to hydrolyze linkages between N-acetylglucosamines. It has been demonstrated to be an inhibitor of chemotaxis and of the production of toxic oxygen free radicals and may also have some role in the calcification process. As such, there is substantial interest in identifying novel polypeptides having homology to lysozyme. We describe herein the identification of a novel polypeptide which has sequence similarity to lysozyme.

35. PROS864

Wnt-4 is a secreted glycoprotein which correlates with, and is required for, kidney tubulogenesis. Mice lacking Wnt4 activity fail to form pretubular cell aggregates; however, other aspects of mesenchymal and ureteric development are unaffected. Thus, Wnt4 appears to act as an autoinducer of the mesenchyme to epithelial transition that underlies nephron development. Stark et al., *Nature;* 372 (6507):679–683 (1994). In addition, members of the Wnt gene family code for cysteine-rich, secreted proteins, which are differentially expressed in the developing brain and possibly act as intercellular signaling molecules. A Wnt gene, e.g., Wnt-1 is known to be essential for specification of the midbrain cell fate. Yoshioka et al., *Biochem. Biophys. Res. Commun.* 203(3):1581–1588 (1994). Several member of the Wnt family of secreted factors are strongly implicated as regulators of mammary cellular growth and differentiation. Shimizu et al., *Cell Growth Differ.* 8(12) 1349–1358. Wnt-4 is normally expressed in early pregnancy. Wnt-4 may therefore be a local signal driving epithelial branching in pregnancy. Edwards P A, *Biochem Soc Symp* 63:21–34 (1998). See also, Lipschutz J H, *Am. J. Kidney Dis.* 31(3): 383–397, (1998). We describe herein the identification and characterizaton of a novel polypeptide which has sequence similarity to Wnt-4, designated herein as PRO864.

36. PRO792

At least two cell-derived signals have been shown to be necessary for the induction of immunoglobulin isotype switching in B-cells. The first signal is given by either of the soluble lymphokines, interleukin (IL)-4 or IL-13, which induce germline epsilon transcript expression, but this alone is insufficient to trigger secretion of immunoglobulin E (IgE). The second signal is provided by a physical interaction between B-cells and activated T-cells, basophils and mast cells, and it has been shown that the CD40/CD40 ligand pairing is crucial for mediating IgE synthesis. Additionally, amongst the numerous pairs of surface adhesion molecules that are involved in IgE synthesis, the CD23/CD21 pair appears to play a key role in the generation of IgE. CD23 is a protein that is positively and negatively regulated by factors, which increase or decrease IgE production, respectively. Antibodies to CD23 have been shown to inhibit IL-4 induced human IgE production in vitro and to inhibit antigen-specific IgE responses in a rat model, in an isotype selective manner (Bonnefoy et al., *Eur. Respir. J. Suppl.* 22:63S–66S (1996)). CD23 interacts with CD21 on B-cells, preferentially driving IgE production. Given that the CD23 protein plays an extremely important role in the induction of a mammalian IgE response, there is significant interest in identifying novel polypeptides having homology to CD23. We herein describe the identification and characterization of a novel polypeptide having homology to CD23, designated herein as PRO792.

37. PRO866

Mindin and spondin proteins are secreted proteins that are structurally related to one another and which have been identified in a variety of organisms. For example, Higashijima et al., *Dev Biol.* 192:211–227 (1997) have reported the identification of spondin and mindin expression in floor plate cells in the zebrafish embryonic axis, thereby suggesting that mindin and spondin proteins play important roles in embryonic development. This same group has reported that mindin and spondin proteins function as extracellular matrix proteins that have a high affinity for the basal lamina. (Id.). It has been reported that F-spondin is a secreted protein that promotes neural adhesion and neurite extension (Klar et al., *Cell* 69:95–110 (1992) and that M-spondin is an extracellular matrix protein that localizes to muscle attachment sites in *Drosophila* (Umemiya et al., *Dev. Biol.* 186:165–176 (1997)). Thus, there is significant interest in identifying novel polypeptides having homology to the mindin and spondin proteins. We herein describe the identification and characterization of a novel polypeptide having homology to mindin2 and Mindin1, designated herein as PRO866.

38. PRO871

Cyclophilins are a family of proteins that bind to cyclosporin A and possess peptide-propyl cis-trans isomerase activity (Sherry et al., *Proc. Natl. Acad. Sci. USA* 95:1758–1763 (1998)). In addition, cyclophilins are secreted by activated cells and act in a cytokine-like manner, presumably via signaling through a cell surface cyclophilin receptor. Host cell-derived cyclophilin A has been shown to be incorporated into HIV-1 virions and its incorporation has been shown to be essential for viral infectivity. Thus, one or more the cyclophilins may be directly associated with HIV-1 infectivity. Given the obvious importance of the cyclophilin proteins, there is substantial interest in identifying novel polypeptides which have sequence homology to one or more of the cyclophilin proteins. We herein describe the identification and characterization of a novel polypeptide having homology to cyclophilin-like protein CyP-60, designated herein as PRO871.

39. PRO873

Enzymatic proteins play important roles in the chemical reactions involved in the digestion of foods, the biosynthesis of macromolecules, the controlled release and utilization of chemical energy, and other processes necessary to sustain life. Enzymes have also been shown to play important roles in combating various diseases and disorders. For example, liver carboxylesterases have been reported to assist in sensitizing human tumor cells to the cancer prodrugs. Danks et al, report that stable expression of the cDNA encoding a carboxylesterase in Rh30 human rhabdomyosarcoma cells increased the sensitivity of the cells to the CPT-11 cancer prodrug 8.1-fold. *Cancer Res.* (1998) 58(1):20–22. The authors propose that this prodrug/enzyme combination could be exploited therapeutically in a manner analogous to approaches currently under investigation with the combinations of ganciclovir/herpes simplex virus thymidine kinase and 5-fluorocytosine/cytosine deaminase. van Pelt et al. demonstrated that a 55 kD human liver carboxylesterase inhibits the invasion of *Plasmodium falciparum* malaria sporozoites into primary human hepatocytes in culture. *J. Hepatol* (1997) 27(4):688–698.

Carboxylesterases have also been found to be of importance in the detoxification of drugs, pesticides and other xenobiotics. Purified human liver carboxylesterases have been shown to be involved in the metabolism of various drugs including cocaine and heroin. Prindel et al. describe the purification and cloning of a broad substrate specificity human liver carboxylesterase which catalyzes the hydrolysis of cocaine and heroin and which may play an important role in the degradation of these drugs in human tissues. *J. Biol. Chem.* (1997) 6:272(23):14769–14775. Brzenzinski et al. describe a spectrophotometric competitive inhibition assay used to identify drug or environmental esters that are metabolized by carboxylesterases. *Drug Metab Dispos* (1997) 25(9):1089–1096.

In light of the important physiological roles played by carboxylesterases, efforts are being undertaken by both industry and academia to identify new, native carboxylesterase homologs. We herein describe the identification and characterization of a novel polypeptide having homology to carboxylesterase, designated herein as PRO873.

40. PRO940

CD33 is a cell-surface protein that is a member of the sialoadhesin family of proteins that are capable of mediating sialic-acid dependent binding with distinct specificities for both the type of sialic acid and its linkage to subterminal sugars. CD33 is specifically expressed in early myeloid and some monocyte cell lineages and has been shown to be strongly associated with various myeloid tumors including, for example, acute non-lymphocytic leukemia (ANLL). As such, CD33 has been suggested as a potential target for the treatment of cancers associated with high level expression of the protein. There is, therefore, significant interest in the identification of novel polypeptides having homology to CD33. In fact, one CD33 homolog (designated CD33L) has already been identified and described (see Takei et al., *Cytogenet. Cell Genet.* 78:295–300 (1997)). We herein describe the identification of another novel polypeptide having homology to CD33, designated herein as PRO940. The novel polypeptide described herein also exhibits significant homology to the human OB binding proteins designated HSU71382_1 and HSU71383_1 in the Dayhoff database (version 35.45 SwissProt 35).

41. PRO941

Cadherins are a large family of transmembrane proteins. Cadherins comprise a family of calcium-dependent glycoproteins that function in mediating cell-cell adhesion in virtually all solid tissues of multicellular organisms. At least cadherins 1–13 as well as types B, E, EP, M, N, P and R have been identified and characterized. Among the functions cadherins are known for, with some exceptions, are that cadherins participate in cell aggregation and are associated with cell-cell adhesion sites. Recently, it has been reported that while all cadherins share multiple repeats of a cadherin specific motif believed to correspond to folding of extracellular domains, members of the cadherin superfamily have divergent structures and, possibly, functions. In particular it has been reported that members of the cadherin superfamily are involved in signal transduction. See, Suzuki, *J. Cell Biochem.*, 61(4):531–542 (1996). Cadherins are further described in Tanihara et al., *J. Cell Sci.*, 107(6):1697–1704 (1994), Aberle et al., *J. Cell Biochem.*, 61(4):514–523 (1996) and Tanihara et. al., *Cell Adhes. Commun.*, 2(1): 15–26 (1994). We herein describe the identification and characterization of a novel polypeptide having homology to a cadherin protein, designated herein as PRO941.

42. PRO944

Clostridium perfringens enterotoxin (CPE) is considered to be the virulence factor responsible for causing the symptoms of *C. perfringens* type A food poisoning and may also be involved in other human and veterinary illnesses (McClane, *Toxicon.* 34:1335–1343 (1996)). CPE carries out its adverse cellular functions by binding to an approximately 50 kD cell surface receptor protein designated the Clostridium perfringens enterotoxin receptor (CPE-R) to form an approximately 90,000 kD complex on the surface of the cell. cDNAs encoding the CPE-R protein have been identified characterized in both human and mouse (Katahira et al., *J. Cell Biol.* 136:1239–1247 (1997) and Katahira et al., *J. Biol. Chem.* 272:26652–26658 (1997)). Since the CPE toxin has been reported to cause a variety of illnesses in mammalian hosts and those illnesses are initiated by binding of the CPE toxin to the CPE-R, there is significant interest in identifying novel CPE-R homologs. We herein describe the identification and characterization of a novel polypeptide having homology to the CPE-R, designated herein as PRO944.

43. PRO983

Membrane-bound proteins include not only cell-surface membrane-bound proteins, but also proteins that are found on the surface of intracellular vesicles. These vesicles are involved in exocytosis, which is the fusion of secretory vesicles with the cellular plasma membrane, and have two main functions. One is the discharge of the vesicle contents into the extracellular space, and the second is the incorporation of new proteins and lipids into the plasma membrane itself. Exocytosis can be either constitutive or regulated. All eukaryotic cells exhibit constitutive exocytosis, which is marked by the immediate fusion of the secretory vesicle after formation. In contrast, regulated exocytosis results in the accumulation of the secretory vesicles that fuse with the plasma membrane upon receipt of an appropriate signal by vesicle-associated membrane proteins. Usually, this signal is an increase in the cytosolic free $Ca^{2+}$ concentration. However, regulated exocytosis that is independent of $Ca^{2+}$ has been reported (see, e.g. Fujita-Yoshigaki et al *J. Biol. Chem.* (1996) 31:271(22):13130–13134). Regulated exocytosis is crucial to many specialized cells, including neurons (neurotransmitter release from synaptic vesicles), adrenal chromaffin cells (adrenaline secretion), pancreatic acinar cells (digestive enzyme secretion), pancreatic β-cells (insulin secretion), mast cells (histamine secretion), mammary cells (milk protein secretion), sperm (enzyme secretion), egg cells (creation of fertilization envelope) and adipocytes (insertion of glucose transporters into the plasma membrane).

Disorders involving exocytosis are known. For example, inflammatory mediator release from mast cells leads to a variety of disorders, including asthma. Similarly, Chediak-Higashi Syndrome (CHS) is a rare autosomal recessive disease in which neutrophils, monocytes and lymphocytes contain giant cytoplasmic granules. Accordingly, the proteins involved in exocytosis are of paramount interest and efforts are being undertaken by both industry and academia to identify new, vesicle-associated proteins. For example, Skehel et al. identified a 33-kilodalton membrane protein in Aplysia, termed VAP-33, which is required for the exocytosis of neurotransmitter. *Science* (1995) 15:269(5230):1580–1583, and *Neuropharmacology* (1995) 34(11):1379–1385. Many efforts are focused on the screening of mammalian recombinant DNA libraries to identify the coding sequences for novel vesicle-associated membrane proteins. It is an object of the invention to provide proteins having homology to the vesicle associated protein, VAP-33, designated herein as PRO983.

44. PRO1057

Proteases are enzymatic proteins which are involved in a large number of very important biological processes in mammalian and non-mammalian organisms. Numerous different protease enzymes from a variety of different mammalian and non-mammalian organisms have been both identified and characterized. The mammalian protease enzymes play important roles in many different biological processes including, for example, protein digestion, activation, inactivation, or modulation of peptide hormone activity, and alteration of the physical properties of proteins and enzymes.

In light of the important physiological roles played by protease enzymes, efforts are currently being undertaken by both industry and academia to identify new, native protease homologs. Many of these efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.,* 93:7108–7113 (1996); U.S. Pat. No. 5,536,637)]. We herein describe the identification of novel polypeptides having homology to various protease enzymes, designated herein as PRO1057 polypeptides.

45. PRO1071

Thrombospondin-1 is a trimeric high molecular weight glycoprotein that is released from platelet alpha-granules in response to thrombin stimulation and that is also a transient component of the extracellular matrix in developing and repairing tissues (Adams, *Int. J. Biochem. Cell Biol.* 29:861–865 (1997) and Qian et al., *Proc. Soc. Exp. Biol. Med.* 212:199–207 (1996)). A variety of factors regulate thrombospondin expression and the protein is degraded by both extracellular and intracellular routes. Thrombospondin-1 functions as a cell adhesion molecule and also modulates cell movement, cell proliferation, neurite outgrowth and angiogenesis. As such, there is substantial interest in identifying novel polypeptides having homology to thrombospondin. We herein describe the identification and characterization of a novel polypeptide having homology to thrombospondin, designated herein as PRO1071.

46. PRO1072

Studies have reported that the redox state of the cell is an important determinant of the fate of the cell. Furthermore, reactive oxygen species have been reported to be cytotoxic, causing inflammatory disease, including tissue necrosis, organ failure, atherosclerosis, infertility, birth defects, premature aging, mutations and malignancy. Thus, the control of oxidation and reduction is important for a number of reasons, including the control and prevention of strokes, heart attacks, oxidative stress, hypertension and may be associated with the development of malignancies. The levels of antioxidant enzymes, such as reductases, which catalyze the conversion of reactive oxygen species to water have been shown to be low in cancer cells. In particular, malignant prostate epithelium may have lowered expression of such antioxidant enzymes [Baker et al., *Prostate* 32(4): 229–233 (1997)]. In this regard, reductases, are of interest. In addition, the transcription factors, NF-kappa B and AP-1, are known to be regulated by redox state and to affect the expression of a large variety of genes thought to be involved in the pathogenesis of AIDS, cancer, atherosclerosis and diabetic complications. Publications further describing this subject matter include Engman et al., *Anticancer Res. (Greece),* 17:4599–4605 (1997), Kelsey, et al., *Br. J. Cancer,* 76(7):852–854 (1997); Friedrich and Weiss, *J. Theor. Biol.,* 187(4):529–40 (1997) and Pieulle, et al., *J. Bacteriol.,* 179(18):5684–92 (1997). Given the physiological importance of redox reactions in vivo, efforts are currently being under taken to identify new, native proteins which are involved in redox reactions. We describe herein the identification of a novel polypeptide which has sequence similarity to reductase enzymes, designated herein as PRO1072.

47. PRO1075

Protein disulfide isomerase is an enzymatic protein which is involved in the promotion of correct refolding of proteins through the establishment of correct disulfide bond formation. Protein disulfide isomerase was initially identified based upon its ability to catalyze the renaturation of reduced denatured RNAse (Goldberger et al., *J. Biol. Chem.* 239: 1406–1410 (1964) and Epstein et al., *Cold Spring Harbor Symp. Quant. Biol.* 28:439–449 (1963)). Protein disulfide isomerase has been shown to be a resident enzyme of the endoplasmic reticulum which is retained in the endoplasmic reticulum via a -KDEL or -HDEL amino acid sequence at its C-terminus.

Given the importance of disulfide bond-forming enzymes and their potential uses in a number of different applications, for example in increasing the yield of correct refolding of recombinantly produced proteins, efforts are currently being undertaken by both industry and academia to identify new, native proteins having homology to protein disulfide isomerase. Many of these efforts are focused on the screening of mammalian recombinant DNA libraries to identify the coding sequences for novel protein disulfide isomerase homologs. Examples of screening methods and techniques are described in the literature [see, for example, Klein et al., *Proc. Natl. Acad. Sci.* 93:7108–7113 (1996); U.S. Pat. No. 5,536,637)]. We herein describe a novel polypeptide having homology to protein disulfide isomerase, designated herein as PRO1075.

48. PRO181

In *Drosophila*, the dorsal-ventral polarity of the egg chamber depends on the localization of the oocyte nucleus and the gurken RNA to the dorsal-anterior corner of the oocyte. Gurken protein presumably acts as a ligand for the *drosophila* EGF receptor (torpedo/DER) expressed in the somatic follicle cells surrounding the oocyte. Cornichon is a gene required in the germline for dorsal-ventral signaling (Roth et al., *Cell* 81:967–978 (1995)). Cornichon, gurken and torpedo also function in an earlier signaling event that establishes posterior follicle cell fates and specifies the anterior-posterior polarity of the egg chamber. Mutations in any or all of these genes prevent the formation of a correctly polarized microtubule cytoskeleton required for proper localization of the anterior and posterior determinants bicoid and oskar and for the asymmetric positioning of the oocyte nucleus. Thus, it is clear that the cornichon gene product plays an important role in early development. We herein describe the identification and characterization of a novel polypeptide having homology to the cornichon protein, designated herein as PRO181.

49. PRO195

Efforts are currently being undertaken to identify and characterize novel transmembrane proteins. We herein describe the identification and characterization of a novel transmembrane polypeptide, designated herein as PRO195.

50. PRO865

Efforts are currently being undertaken to identify and characterize novel secreted proteins. We herein describe the identification and characterization of a novel secreted polypeptide, designated herein as PRO865.

51. PRO827

VLA-2 is an cell-surface integrin protein that has been identified and characterized in a number of mammalian organisms, including both mouse and human. VLA-2 has been shown to be a receptor on the surface of cells for echovirus-1 (EV-1) which mediates infection of VLA-2-expressing cells by EV-1 (Zhang et al., *Virology* 235(2): 293–301 (1997) and Bergelson et al., *Science* 255:1718–1720 (1992)). VLA-2 has also been shown to mediate the interaction of collagen with endothelium during in vitro vascular tube formation (Jackson et al., *Cell Biol. Int.* 18(9):859–867 (1994)). Various other integrin proteins that share various degrees of amino acid sequence homology with VLA-2 have been identified and characterized in a variety of mammalian organism. These integrins have been reported to play important roles in a variety of different physiological functions. Therefore, there is significant interest in identifying novel polypeptides having homology to one or more of the integrin proteins. We herein describe the identification and characterization of a novel polypeptide having homology to VLA-2 integrin protein, designated herein as PRO827.

52. PRO1114

Many important cytokine proteins have been identified and characterized and shown to signal through specific cell surface receptor complexes. For example, the class II cytokine receptor family (CRF2) includes the interferon receptors, the interleukin-10 receptor and the tissue factor CRFB4 (Spencer et al., *J. Exp. Med.* 187:571–578 (1998) and Kotenko et al., *EMBO J.* 16:5894–5903 (1997)). Thus, the multitude of biological activities exhibited by the various cytokine proteins is absolutely dependent upon the presence of cytokine receptor proteins on the surface of target cells. There is, therefore, a significant interest in identifying and characterizing novel polypeptides having homology to one or more of the cytokine receptor family. We herein describe the identification and characterization of a novel polypeptide having homology to cytokine receptor family-4 proteins, designated herein as PRO1117.

Interferons (IFNs) encompass a large family of secreted proteins occurring in vertebrates. Although they were originally named for their antiviral activity, growing evidence supports a critical role for IFNs in cell growth and differentiation (Jaramillo et al., *Cancer Investigation* 13(3):327–338 (1995)). IFNs belong to a class of negative growth factors having the ability to inhibit the growth of a wide variety of cells with both normal and transformed phenotypes. IFN therapy has been shown to be beneficial in the treatment of human malignancies such as Karposi's sarcoma, chronic myelogenous leukemia, non-Hodgkin's lymphoma, and hairy cell leukemia as well as in the treatment of infectious diseases such as hepatitis B (Gamliel et al., *Scanning Microscopy* 2(1):485–492 (1988), Einhorn et al., *Med. Oncol. & Tumor Pharmacother.* 10:25–29 (1993), Ringenberg et al., *Missouri Medicine* 85(1):21–26 (1988), Saracco et al., *Journal of Gastroenterology and Hepatology* 10:668–673 (1995), Gonzalez-Mateos et al., *Hepato-Gastroenterology* 42:893–899 (1995) and Malaguarnera et al., *Pharmacotherapy* 17(5):998–1005 (1997)).

Interferons can be classified into two major groups based upon their primary sequence. Type I interferons, IFN-α and IFN-β, are encoded by a superfamily of intronless genes consisting of the IFN-α gene family and a single IFN-β gene that are thought to have arisen from a common ancestral gene. Type I interferons may be produced by most cell types. Type II IFN, or IFN-γ, is restricted to lymphocytes (T cells and natural killer cells) and is stimulated by nonspecific T cell activators or specific antigens in vivo.

Although both type I and type II IFNs produce similar antiviral and antiproliferative effects, they act on distinct cell surface receptors, wherein the binding is generally species specific (Langer et al., *Immunol. Today* 9:393–400 (1988)).

Both IFN-α and IFN-β bind competitively to the same high affinity type I receptor, whereas IFN-γ binds to a distinct type II receptor. The presence and number of IFN receptors on the surface of a cell does not generally reflect the sensitivity of the cell to IFN, although it is clear that the effects of the IFN protein is mediated through binding to a cell surface interferon receptor. As such, the identification and characterization of novel interferon receptor proteins is of extreme interest.

We herein describe the identification and characterization of novel interferon receptor polypeptides, designated herein as "PRO1114 interferon receptor" polypeptides. Thus, the PRO1114 polypeptides of the present invention represents a novel cell surface interferon receptor.

53. PRO237

Carbonic anhydrase is an enzymatic protein that which aids carbon dioxide transport and release in the mammalian blood system by catalyzing the synthesis (and the dehydration) of carbonic acid from (and to) carbon dioxide and water. Thus, the actions of carbonic anhydrase are essential for a variety of important physiological reactions in the mammal. As such, there is significant interest in the identification and characterization of novel polypeptides having homology to carbonic anhydrase. We herein describe the identification and characterization of a novel polypeptide having homology to carbonic anhydrase, designated herein as PRO237.

54. PRO541

Numerous trypsin inhibitory proteins have been identified and characterized (see, e.g., Yamakawa et al., *Biochim. Biophys. Acta* 1395:202–208 (1998) and Mizuki et al., *Mammalian Genome* 3:274–280 (1992)). Trypsin inhibitor proteins play important roles in a variety of different physiological and biological pathways and are specifically involved in such processes as the regulation of protein degradation, digestion, and the like. Given the important roles played by such enzymatic proteins, there is significant interest in identifying and characterizing novel polypeptides having homology to known trypsin inhibitor proteins. We herein describe the identification and characterization of a novel polypeptide having homology to a trypsin inhibitor protein, designated herein as PRO541.

55. PRO273

Leukocytes include monocytes, macrophages, basophils, and eosinophils and play an important role in the immune response. These cells are important in the mechanisms initiated by T and/or B lymphocytes and secrete a range of cytokines which recruit and activate other inflammatory cells and contribute to tissue destruction.

Thus, investigation of the regulatory processes by which leukocytes move to their appropriate destination and interact with other cells is critical. Currently, leukocytes are thought to move from the blood to injured or inflamed tissues by rolling along the endothelial cells of the blood vessel wall. This movement is mediated by transient interactions between selectins and their ligands. Next, the leukocyte must move through the vessel wall and into the tissues. This diapedesis and extravasation step involves cell activation which promotes a more stable leukocyte-endothelial cell interaction, again mediated by integrins and their ligands.

Chemokines are a large family of structurally related polypeptide cytokines. These molecules stimulate leukocyte movement and may explain leukocyte trafficking in different inflammatory situations. Chemokines mediate the expression of particular adhesion molecules on endothelial cells, and they produce chemoattractants which activate specific cell types. In addition, the chemokines stimulate proliferation and regulate activation of specific cell types. In both of these activities, chemokines demonstrate a high degree of target cell specificity.

The chemokine family is divided into two subfamilies based on whether two amino terminal cysteine residues are immediately adjacent (C—C) or separated by one amino acid (C—X—C). Chemokines of the C—X—C family generally activate neutrophils and fibroblasts while the C—C chemokines act on a more diverse group of target cells including monocytes/macrophages, basophils, eosinophils and T lymphocytes. The known chemokines of both subfamilies are synthesized by many diverse cell types as reviewed in Thomson A. (1994) The Cytokine Handbook, 2 d Ed. Academic Press, N.Y. Chemokines are also reviewed in Schall T J (1994) Chemotactic Cytokines: Targets for Therapeutic Development. International Business Communications, Southborough Mass. pp 180–270; and in Paul W E (1993) Fundamental immunology, 3rd Ed. Raven Press, N.Y. pp 822–826.

Known chemokines of the C—X—C subfamily include macrophage inflammatory proteins alpha and beta (MIP-1 and MIP-2), interleukin-8 (IL-8), and growth regulated protein (GRO-alpha and beta).

MIP-2 was first identified as a 6 kDa heparin binding protein secreted by the mouse macrophage cell line RAW 264.7 upon stimulation with lipopolysaccharide (LPS). MIP-2 is a member of the C—X—C (or CXC) subfamily of chemokines. Mouse MIP-2 is chemotactic for human neutrophils and induces local neutrophil infiltration when injected into the foot pads of mice. Rat MIP-2 shows 86% amino acid homology to the mouse MIP-2 and is chemotactic for rat neutrophils but does not stimulate migration of rat alveolar macrophages or human peripheral blood eosinophils or lymphocytes. In addition, the rat MIP-2 has been shown to stimulate proliferation of rat alveolar epithelial cells but not fibroblasts.

Current techniques for diagnosis of abnormalities in inflamed or diseased issues mainly rely on observation of clinical symptoms or serological analyses of body tissues or fluids for hormones, polypeptides or various metabolites. Problems exist with these diagnostic techniques. First, patients may not manifest clinical symptoms at early stages of disease. Second, serological tests do not always differentiate between invasive diseases and genetic syndromes. Thus, the identification of expressed chemokines is important to the development of new diagnostic techniques, effective therapies, and to aid in the understanding of molecular pathogenesis.

To date, chemokines have been implicated in at least the following conditions: psoriasis, inflammatory bowel disease, renal disease, arthritis, immune-mediated alopecia, stroke, encephalitis, MS, hepatitis, and others. In addition, non-ELR-containing chemokines have been implicated in the inhibition of angiogenesis, thus indicating that these chemokines have a rule in tumor vascularization and tumorigenesis.

Therefore it is the object of this invention to identify polypeptides and nucleic acids encoding the same which have sequence identity and similarity with cytokine-induced neutrophil chemoattractants, MIP-1, MIP-2, and other related proteins. The efforts of this object are provided herein.

56. PRO701

Beta neurexins and neuroligins are plasma membrane proteins that are displayed on the neuronal cell surface. Neuroligin 1 is enriched in synaptic plasma membranes and acts as a splice site-specific ligand for beta neurexins as described in Ichtchenko, et al., *Cell,* 81(3):435–443 (1995). The extracellular sequence of neuroligin 1 is composed of a catalytically inactive esterase domain homologous to acetylcholinesterase. Neuroligin 2 and 3 are similar in structure and sequence to neuroligin 1. All neuroligins contain an N-terminal hydrophobic sequence with the characteristics of a cleaved signal peptide followed by a large esterase homology domain, a highly conserved single transmembrane region, and a short cytoplasmic domain. The three neuroligins are alternatively spliced at the same position and are expressed at high levels only in the brain. Tight binding of the three neuroligins to beta neurexins is observed only for beta neurexins lacking an insert in splice site 4. Thus, neuroligins constitute a multigene family of brain-specific proteins with distinct isoforms that may have overlapping functions in mediating recognition processes between neurons, see Ichtchenko, et al., *J. Biol. Chem.,* 271(5):2676–2682 (1996). Moreover, neurexins and neuroligins have been reported as functioning as adhesion molecules in a $Ca^{2+}$ dependent reaction that is regulated by alternative splicing of beta neurexins, i.e., see Nguyen and Sudhof, *J. Biol. Chem.,* 272(41):26032–26039 (1997). Given the foregoing, membrane bound proteins are of interest. More generally, membrane-bound proteins and receptors can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor ligand interaction. The membrane-bound proteins can also be employed for screening of potential peptide or small molecule inhibitors of the relevant receptor/ligand interaction.

Efforts are being undertaken by both industry and academia to identify new, native membrane-bound receptor proteins, particularly those having sequence identity and/or similarity with neuroligins 1, 2 and 3. Many efforts are focused on the screening of mammalian recombinant DNA libraries to identify the coding sequences for novel secreted and membrane-bound receptor proteins. Examples of screening methods and techniques are described in the literature [see, for example, Klein et al., *Proc. Natl. Acad. Sci.,* 93:7108–7113 (1996); U.S. Pat. No. 5,536,637)]. The results of such efforts are provided herein.

57. PRO704

VIP36 is localized to the Golgi apparatus and the cell surface, and belongs to a family of legume lectin homologues in the animal secretory pathway that might be involved in the trafficking of glycoproteins, glycolipids, or both. It is further believed that VIP36 binds to sugar residues of glycosphingolipids and/or gycosylphosphatidyl-inositol anchors and might provide a link between the extracellular/luminal face of glycolipid rafts and the cytoplasmic protein segregation machinery. Further regarding VIP36, it is believed that there is a signal at its C-terminus that matches an internalization consensus sequence which confers its ability to cycle between the plasma membrane and Golgi. See, Fiedler, et al, *EMBO J.,* 13(7):1729–1740 (1994); Fiedler and Simons, *J. Cell Sci.,* 109(1):271–276 (1996); Itin, et al., *MBO J.,* 14(10):2250–2256 (1995). It is believed that VIP36 is either the same as or very closely related to the human GP36b protein. VIP36 and/or GP36b are of interest.

More generally, vesicular, cytoplasmic, extracellular and membrane-bound proteins play important roles in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment, usually at a membrane-bound receptor protein.

Secreted proteins have various industrial applications, including use as pharmaceuticals, diagnostics, biosensors and bioreactors. In fact, most protein drugs available at present, such as thrombolytic agents, interferons, interleukins, erythropoietins, colony stimulating factors, and various other cytokines, are secretory proteins. Their receptors, which are membrane-bound proteins, also have potential as therapeutic or diagnostic agents. Receptor immunoadhesins, for instance, can be employed as therapeutic agents to block receptor-ligand interaction. Membrane-bound proteins can also be employed for screening of potential peptide or small molecule inhibitors of the relevant receptor/ligand interaction. Such membrane-bound proteins and cell receptors include, but are not limited to, cytokine receptors, receptor kinases, receptor phosphatases, receptors involved in cell-cell interactions, and cellular adhesin molecules like selectins and integrins. Transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Efforts are being undertaken by both industry and academia to identify new, native vesicular, cytoplasmic, secreted and membrane-bound receptor proteins, particularly those having sequence identity and/or similarity with VIP36. Many efforts are focused on the screening of mammalian recombinant DNA libraries to identify the coding sequences for novel secreted and membrane-bound receptor proteins. Examples of screening methods and techniques are described in the literature [see, for example, Klein et al., *Proc. Natl. Acad. Sci.*, 93:7108–7113 (1996); U.S. Pat. No. 5,536,637)].

58. PRO706

Acid phophatase proteins are secreted proteins which dephophorylate terminal phosphate groups under acidic pH conditions. Acid phophatases contain a RHGXRXP amino acid sequence, which is predicted to be mechanistically significant. Acid phosphatases may have important functions in the diagnosis and treatment of human diseases. For example, prostatic acid phosphatase is a secreted protein uniquely expressed in prostatic tissue and prostate cancer. The level of prostatic acid phosphatase is a potential prognostic factor for local and biochemical control in prostate cancer patients treated with radiotherapy, as described in Lankford et al., *Int. J. Radiat. Oncol. Biol. Phys.* 38(2): 327–333 (1997). Research suggests that a cellular immune response to prostatic acid phosphatase may mediate destructive autoimmune prostatitis, and that xenogeneic forms of prostatic acid phosphatase may prove useful for immunotherapy of prostate cancer. See Fong et al., *J. Immunol.* 169(7): 3113–3117(1997). Seminal prostatic acidphosphatase levels correlate significantly with very low sperm levels (oligospermia) in individuals over 35, see Singh et al., *Singapore Med. J.* 37(6): 598–599 (1996). Thus, prostatic acid phosphatase has been implicated in a variety of human diseases, and may have an important function in diagnosis and therapy of these diseases. A series of aminobenzylphosphatic acid compounds are highly potent inhibitors of prostatic acid phosphatase, as described in Beers et al., *Bioorg. Med. Chem.* 4(10): 1693–1701 (1996).

More generally, extracellular proteins play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins, particularly those having sequence identity with prostate acid phosphatase precursor and lysosomal acid phosphatase precursor and in some cases, those having identity with DNA found in fetal heart. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)].

59. PRO707

Cadherins are a large family of transmembrane proteins. At least cadherins 1–13 as well as types B, E, EP, M, N, P and R have been characterized. Among the functions cadherins are known for, with some exceptions, cadherins participate in cell aggregation and are associated with cell-cell adhesion sites. Cadherins are further described in Tanihara, et al., *J. Cell Sci.*, 107(6):1697–1704 (1994) and Tanihara, et al., *Cell Adhes., Commun.*, 2(1):15–26 (1994). Moreover, it has been reported that some members of the cadherin superfamily are involved in general cell interaction processes including transduction. See, Suzuki, *J. Cell Biochem.*, 61(4):531–542 (1996). Therefore, novel members of the cadherin superfamily are of interest.

More generally, all novel proteins are of interest, including membrane-bound proteins. Membrane-bound proteins and receptors can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Efforts are being undertaken by both industry and academia to identify new, native secreted and membrane-bound receptor proteins, particularly membrane bound proteins having identity with cadherins. The results of such efforts are provided herein.

60. PRO322

Proteases are enzymatic proteins which are involved in a large number of very important biological processes in mammalian and non-mammalian organisms. Numerous different protease enzymes from a variety of different mammalian and non-mammalian organisms have been both identified and characterized, including the serine proteases which exhibit specific activity toward various serine-containing proteins. The mammalian protease enzymes play important roles in biological processes such as, for example, protein digestion, activation, inactivation, or modulation of peptide hormone activity, and alteration of the physical properties of proteins and enzymes.

Neuropsin is a novel serine protease whose MRNA is expressed in the central nervous system. Mouse neuropsin has been cloned, and studies have shown that it is involved in the hippocampal plasticity. Neuropsin has also been indicated as associated with extracellular matrix modifications and cell migrations. See, generally, Chen, et al., *Neurosci.*, 7(2):5088–5097 (1995) and Chen, et al., *J. Histochem. Cytochem.*, 46:313–320 (1988).

Efforts are being undertaken by both industry and academia to identify new, native membrane-bound or secreted proteins, particularly those having homology to neuropsin, serine protease, neurosin and trypsinogen. Many efforts are focused on the screening of mammalian recombinant DNA libraries to identify the coding sequences for novel secreted and membrane-bound receptor proteins. Examples of screening methods and techniques are described in the literature [see, for example, Klein et al., *Proc. Natl. Acad. Sci.*, 93:7108–7113 (1996); U.S. Pat. No. 5,536,637)].

61. PRO526

Protein-protein interactions include those involved with receptor and antigen complexes and signaling mechanisms. As more is known about the structural and functional mechanisms underlying protein-protein interactions, protein-protein interactions can be more easily manipulated to regulate the particular result of the protein-protein interaction. Thus, the underlying mechanisms of protein-protein interactions are of interest to the scientific and medical community.

All proteins containing leucine-rich repeats are thought to be involved in protein-protein interactions. Leucine-rich repeats are short sequence motifs present in a number of proteins with diverse functions and cellular locations. The crystal structure of ribonuclease inhibitor protein has revealed that leucine-rich repeats correspond to beta-alpha structural units. These units are arranged so that they form a parallel beta-sheet with one surface exposed to solvent, so that the protein acquires an unusual, nonglobular shape. These two features have been indicated as responsible for the protein-binding functions of proteins containing leucine-rich repeats. See, Kobe and Deisenhofer, *Trends Biochem. Sci.*, 19(10):415–421 (October. 1994).

A study has been reported on leucine-rich proteoglycans which serve as tissue organizers, orienting and ordering collagen fibrils during ontogeny and are involved in pathological processes such as wound healing, tissue repair, and tumor stroma formation. Iozzo, R. V., *Crit. Rev. Biochem. Mol. Biol.*, 32(2):141–174 (1997). Others studies implicating leucine rich proteins in wound healing and tissue repair are De La Salle, C., et al., *Vouv. Rev. Fr. Hematol.* (Germany), 37(4):215–222 (1995), reporting mutations in the leucine rich motif in a complex associated with the bleeding disorder Bernard-Soulier syndrome, Chlemetson, K. J., *Thromb. Haemost.* (Germany), 74(1):111–116 (July 1995), reporting that platelets have leucine rich repeats and Ruoslahti, E. I., et al., WO9110727-A by La Jolla Cancer Research Foundation reporting that decor in binding to transforming growth factorβ has involvement in a treatment for cancer, wound healing and scarring. Related by function to this group of proteins is the insulin like growth factor (IGF), in that it is useful in wound-healing and associated therapies concerned with re-growth of tissue, such as connective tissue, skin and bone; in promoting body growth in humans and animals; and in stimulating other growth-related processes. The acid labile subunit (ALS) of IGF is also of interest in that it increases the half-life of IGF and is part of the IGF complex in vivo. ALS is further described in Leong and Baxter, *Mol. Endocrinol.*, 6(6):870–876 (1992); Baxter, *J. Biol. Chem.*, 264(20):11843–11848 (1989); and Khosravi, et al., *J. Clin. Endocrinol. Metab.*, 82(12):3944–3951 (1997).

Another protein which has been reported to have leucine-rich repeats is the SLIT protein which has been reported to be useful in treating neuro-degenerative diseases such as Alzheimer's disease, nerve damage such as in Parkinson's disease, and for diagnosis of cancer, see, Artavanistsakonas, S. and Rothberg, J. M., WO9210518-A1 by Yale University. Also of interest is LIG-1, a membrane glycoprotein that is expressed specifically in glial cells in the mouse brain, and has leucine rich repeats and immunoglobulin-like domains. Suzuki, et al., *J. Biol. Chem.* (U.S.), 271(37):22522 (1996). Other studies reporting on the biological functions of proteins having leucine rich repeats include: Tayar, N., et al., *Mol. Cell Endocrinol.*, (Ireland), 125(1–2):65–70 (December 1996) (gonadotropin receptor involvement); Miura, Y., et al., *Nippon Rinsho* (Japan), 54(7):1784–1789 (July 1996) (apoptosis involvement); Harris, P. C., et al., *J. Am. Soc. Nephrol.*, 6(4):1125–1133 (October 1995) (kidney disease involvement).

Efforts are therefore being undertaken by both industry and academia to identify new proteins having leucine rich repeats to better understand protein-protein interactions. Of particular interest are those proteins having leucine rich repeats and identity or similarity to known proteins having leucine rich repeats such as ALS. Many efforts are focused on the screening of mammalian recombinant DNA libraries to identify the coding sequences for novel secreted and membrane-bound proteins having leucine rich repeats. Examples of screening methods and techniques are described in the literature [see, for example, Klein et al., *Proc. Natl. Acad. Sci.*, 93:7108–7113 (1996); U.S. Pat. No. 5,536,637)].

62. PRO531

Cadherins are a large family of transmembrane proteins. Cadherins comprise a family of calcium-dependent glycoproteins that function in mediating cell-cell adhesion in virtually all solid tissues of multicellular organisms. At least cad herins 1–13 as well as types B, E, EP, M, N, P and R have been characterized. Among the functions cadherins are known for, with some exceptions, cadherins participate in cell aggregation and are associated with cell-cell adhesion sites. Recently, it has been reported that while all cadherins share multiple repeats of a cadherin specific motif believed to correspond to folding of extracellular domains, members of the cadherin superfamily have divergent structures and, possibly, functions. In particular it has been reported that members of the cadherin superfamily are involved in signal transduction. See, Suzuki, *J. Cell Biochem.*, 61(4):531–542 (1996). Cadherins are further described in Tanihara, et al., *J. Cell Sci.*, 107(6):1697–1704 (1994), Aberle, et al., *J. Cell Biochem.*, 61(4):514–523 (1996) and Tanihara, et al., *Cell Adhes. Commun.*, 2(1):15–26 (1994).

Protocadherins are members of the cadherin superfamily which are highly expressed in the brain. In some studies, protocadherins have shown cell adhesion activity. See, Sano, et al., *EMBO J.*, 12(6):2249–2256 (1993). However, studies have also shown that some protocadherins, such as protocadherin 3 (also referred to as Pcdh3 or pc3), do not show strong calcium dependent cell aggregation activity. See, Sago, et al., *Genomics*, 29(3):631–640 (1995) for this study and further characteristics of Pcdh3.

Therefore, novel members of the cadherin superfamily are of interest. More generally, all membrane-bound proteins and receptors are of interest. Such proteins can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor imnunoadhesins, for instance, can be employed as therapeutic agents to block receptor-ligand interaction. The membrane-bound proteins can also be employed for screening of potential peptide or small molecule inhibitors of the relevant receptor/ligand interaction.

Efforts are therefore being undertaken by both industry and academia to identify new, native membrane bound proteins, particular those having sequence identity with protocadherins, especially 3 and 4. Many efforts are focused on the screening of mammalian recombinant DNA libraries to identify the coding sequences for novel membrane-bound proteins. Provided herein are the results of such efforts.

63. PRO534

Protein disulfide isomerase is an enzymatic protein which is involved in the promotion of correct refolding of proteins through the establishment of correct disulfide bond formation. Protein disulfide isomerase was initially identified based upon its ability to catalyze the renaturation of reduced denatured RNAse (Goldberger et al., *J. Biol. Chem.* 239: 1406–1410 (1964) and Epstein et al., *Cold Spring Harbor Symp. Quant. Biol.* 28:439–449 (1963)). Protein disulfide isomerase has been shown to be a resident enzyme of the endoplasmic reticulum which is retained in the endoplasmic reticulum via a -KDEL or -HDEL amino acid sequence at its C-terminus. Protein disulfide isomerase and related proteins are further described in Laboissiere, et al., *J. Biol. Chem.*, 270(47:28006–28009 (1995); Jeenes, et al., *Gene,* 193(2): 151–156 (1997; Koivunen, et al., *Genomics,* 42(3):397–404 (1997); and Desilva, et al., *DNA Cell Biol.,* 15(1):9–16 (1996). These studies indicate the importance of the identification of protein disulfide related proteins.

More generally, and also of interest are all novel membrane-bound proteins and receptors. Such proteins can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytoline receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Given the importance of membrane bound proteins, efforts are under way to identity novel membrane bound proteins. Moreover, given the importance of disulfide bond-forming enzymes and their potential uses in a number of different applications, for example in increasing the yield of correct refolding of recombinantly produced proteins, efforts are currently being undertaken by both industry and academia to identify new, native proteins having sequence identity with protein disulfide isomerase. Many of these efforts are focused on the screening of mammalian recombinant DNA libraries to identify the coding sequences for novel protein disulfide isomerase homologs. We herein describe a novel polypeptide having sequence identity with protein disulfide isomerase and the nucleic acids encoding the same.

64. PRO697

Secreted frizzled related proteins (sFRPs) are related to the frizzled family of transmembrane receptors. The sFRPs are approximately 30 kDa in size, and each contains a putative signal sequence, a frizzled-like cysteine-rich domain, and a conserved hydrophilic carboxy-terminal domain. It has been reported that sFRPs may function to modulate Wnt signaling, or function as ligands for certain receptors. Rattner, et al., *PNAS USA,* 94(7):2859–2863 (1997). Therefore, sFRPs and proteins having sequence identity and/or similarity to sFRPs are of interest.

Another secreted protein of interest is any member of the family of secreted apoptosis-related proteins (SARPs). Expression of SARPs modifies the intracellular levels of beta-catenin, suggesting that SARPs interfere with the Wnt-frizzled proteins signaling pathway. Melkonyan, et al., *PNAS USA,* 94(25):13636–13641 (1997). Therefore, SARPs and proteins having sequence identity and/or similarity to SARPs are of interest.

In addition to sFRPs and SARPs, many extracellular proteins are of interest. Extracellular proteins play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents.

Efforts are being undertaken by both industry and academia to identify new, native secreted proteins, particularly those having sequence identity or similarity with sFRP-2 and SARP-1. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)].

65. PRO717

Efforts are being undertaken by both industry and academia to identify new, native transmembrane receptor proteins. Many efforts are focused on the screening of mammalian recombinant DNA libraries to identify the coding sequences for novel receptor proteins. The results of such efforts are provided herein.

66. PRO731

Cadherins are a large family of transmembrane proteins. Cadherins comprise a family of calcium-dependent glycoproteins that function in mediating cell-cell adhesion in virtually all solid tissues of multicellular organisms. At least cadherins 1–13 as well as types B, E, EP, M, N, P and R have been characterized. Among the functions cadherins are known for, with some exceptions, cadherins participate in cell aggregation and are associated with cell-cell adhesion sites. Recently, it has been reported that while all cadherins share multiple repeats of a cadherin specific motif believed to correspond to folding of extracellular domains, members of the cadherin superfamily have divergent structures and, possibly, functions. In particular it has been reported that members of the cad herin superfamily are involved in signal transduction. See, Suzuki, *J. Cell Biochem.*, 61(4):531–542 (1996). Cadherins are further described in Tanihara, et al., *J. Cell Sci.*, 107(6):1697–1704 (1994), Aberle, et al., *J. Cell Biochem.*, 61(4):514–523 (1996) and Tanihara, et al., *Cell Adhes. Commun.*, 2(1):15–26 (1994).

Protocad herins are members of the cad herin superfamily which are highly expressed in the brain. In some studies, protocadherins have shown cell adhesion activity. See, Sano, et al., *EMBO J.*, 12(6):2249–2256 (1993). However, studies have also shown that some protocadherins, such as protocadherin 3 (also referred to as Pcdh3 or pc3), do not show strong calcium dependent cell aggregation activity. See, Sago, et al., *Genomics*, 29(3):631–640 (1995) for this study and further characteristics of Pcdh3.

Therefore, novel members of the cadherin superfamily are of interest. More generally, all membrane-bound proteins and receptors are of interest. Such proteins can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Efforts are therefore being undertaken by both industry and academia to identify new, native membrane bound proteins, particular those having sequence identity with protocadherins, especially 4, 68, 43, 42, 3 and 5. Many efforts are focused on the screening of mammalian recombinant DNA libraries to identify the coding sequences for novel membrane-bound proteins. Provided herein are the results of such efforts.

67. PRO218

Efforts are being undertaken by both industry and academia to identify new, native membrane bound proteins, particularly those having sequence identity with membrane regulator proteins. Many efforts are focused on the screening of mammalian recombinant DNA libraries to identify the coding sequences for novel receptor proteins.

68. PRO768

The integrins comprise a supergene family of cell-surface glycoprotein receptors that promote cellular adhesion. Each cell has numerous receptors that define its cell adhesive capabilities. Integrins are involved in a wide variety of interaction between cells and other cells or matrix components. The integrins are of particular importance in regulating movement and function of immune system cells. The platelet IIb/IIIA integrin complex is of particular importance in regulating platelet aggregation. A member of the integrin family, integrin β-6, is expressed on epithelial cells and modulates epithelial inflammation. Another integrin, leucocyte-associated antigen-1 (LFA-1) is important in the adhesion of lymphocytes during an immune response.

Of particular interest is H36-alpha 7, an integrin alpha chain that is developmentally regulated during myogenesis as described in Song, et al., *J. Cell Biol.*, 117(3):643–657 (1992). The expression pattern of the laminin-binding alpha 7 beta 1 integrin is developmentally regulated in skeletal, cardiac, and smooth muscle. Ziober, et al., *Mol. Biol. Cell*, 8(9):1723–1734 (1997). It has been reported that expression of the alpha 7-X1/X2 integrin is a novel mechanism that regulates receptor affinity states in a cell-specific context and may modulate integrin-dependent events during muscle development and repair. Id. It has further been reported that laminins promote the locomotion of skeletal myoblasts via the alpha 7 integrin receptor. In particular it was reported that alpha 7 beta 1 receptor can promote myoblast adhesion and motility on a restricted number of laminin isoforms and may be important in myogenic precursor recruitment during regeneration and differentiation. Yao, et al., *J. Cell Sci.*, 109(13):3139–3150 (1996). Spliced variants of integrin alpha 7 are also described in Leung, et al., *Biochem. Biophys. Res. Commun.*, 243(1):317–325 (1998) and Fornaro and Languino, *Matrix Biol.*, 16(4): 185–193 (1997). Moreover, it has been reported that absence of integrin alpha 7 causes a form of muscular dystrophy. Thus integrins, particularly those related to integrin 7 and related molecules, are of interest.

In addition to the interest of integrins, more generally, all membrane-bound proteins and receptors are of interest since such proteins can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Therefore, efforts are being undertaken by both industry and academia to identify new, native receptor proteins. Many efforts are focused on the screening of mammalian recombinant DNA libraries to identify the coding sequences for novel receptor proteins. The results of such efforts, particularly those focused on identifying new polypeptides having sequence identity with integrins, are provided herein.

69. PRO771

Testican is a multidomain testicular proteoglycan which is expressed in numerous tissue types including, but not limited to neuromuscular tissue, the brain and reproductive tissues. Testican resembles modulators of cell social behavior such as the regulation of cell shape, adhesion, migration and proliferation. [Bonnet, F. et al., *J. Biol. Chem.*, 271(8): 4373 (1996), Perin, J. P. et al., *EXS* (Switzerland), 70:191 (1994), Alliel, P. M., et al, *Eur. J. Biochem.*, 214(1):346 (1993), Charbonnier, F., et al., *C. R. Seances Soc. Biol. Fil.* (France), 191(1): 127 (1997)]. Among other reasons, since testican has been implicated in neuronal processes and may be associated with the growth of connective tissue, testican and related molecules are of interest.

More generally, all extracellular proteins are of interest. Extracellular proteins play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts, particularly those focused on identifying molecules having identity and/or similarity with testican are of interest.

70. PRO733

T1/ST2 is a receptor-like molecule homologous to the type I interleukin-1 receptor, believed to be involved in cell signaling. The T1/ST2 receptor and/or putative ligands are further described in Gayle, et al., *J. Biol. Chem.*, 271(10): 5784–5789 (1996), Kumar, et al., *J. Biol. Chem.*, 270(46): 27905–27913 (1995), and Mitcham, et al., *J. Biol. Chem.*, 271(10):5777–5783 (1996). These proteins, and proteins related thereto are of interest.

More generally all membrane-bound proteins and receptors are of interest since they can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Efforts are being undertaken by both industry and academia to identify new, native receptor proteins. Many efforts are focused on the screening of mammalian recombinant DNA libraries to identify the coding sequences for novel receptor proteins. The results of such efforts are provided herein.

71. PRO162

Pancreatitis-associated protein (PAP) is a secretory protein that is overexpressed by the pancreas during acute pancreatitis. Serum PAP concentrations have been shown to be abnormally high in patients with acute pancreatitis. Pezzilli et al., *Am. J. Gastroenterol.*, 92(10):1887–1890 (1997).

PAP is synthesized by the pancreas due to pancreatic inflammation and has been shown to be a good serum marker for injury of the pancreas. In addition, serum PAP levels appear to strongly correlate with creatinine clearance measurements. In patients with a pancreas-kidney transplantation, PAP may prove to be a useful biological and histological marker of pancreatic graft rejection. Van der Pijl et al., *Transplantation*, 63(7):995–1003 (1997). Further, PAP has been shown to be useful in screening neonates for cystic fibrosis. In fact, PAP may discriminate cystic fibrosis neonates with better specificity than the current immunoreactive trypsis assay. Iovanna et al., *C. R. Acad. Aci. III*, 317(6): 561–564.

Secreted proteins such as PAP have various industrial applications, including pharmaceuticals, diagnostics, biosensors and bioreactors. Most protein drugs available at present, such as thrombolytic agents, interferons, interleukins, erytiropoietins, colony stimulating factors, and various other cytokines, are secretory proteins. Their receptors, which are membrane proteins, also have potential as therapeutic or diagnostic agents.

Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts are presented herein.

72. PRO788

Anti-neoplastic urinary protein (ANUP) was identified as the major protein present in a fraction of human urine which exhibits antiproliferative activity against human tumor cell lines without affecting the growth of several normal diploid cell lines or tumor cells of mouse or hamster origin. Sloane et al., *Biochem. J.*, 234(2):355–362 (1986).

ANUP is a unique cytokine that has been found in human granulocytes. The N-terminal amino acid sequence has been shown to be unique. A synthetic peptide corresponding to the first nine residues, with Cys at positions 4 and 7, was found to be an anti-tumor agent in vitro. Ridge and Sloane, *Cytokine*, 8(1):1–5 (1996).

Secreted proteins such as ANUP have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)].

73. PRO1008

Dickkopf-1 (dkk-1) is a member of a family of secreted proteins and functions in head induction. Dkk-1 is an inducer of Spemann organizer in amphibian embryos. Glinka, et al., *Nature*, 391(6665):357–362 (1998). Dkk-1 is a potent antagonist of Wnt signalling, suggesting that dkk genes encode a family of secreted Wnt inhibitors. Thus, dkk-1 family members and related molecules are of interest.

More generally, all extracellular proteins are of interest since they can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents.

Efforts are being undertaken by both industry and academia to identify new, native secreted proteins, particularly those related to dkk-1. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts to identify molecules related to dkk-1 are provided herein.

74. PRO1012

Protein disulfide isomerase is an enzymatic protein which is involved in the promotion of correct refolding of proteins through the establishment of correct disulfide bond formation. Protein disulfide isomerase was initially identified based upon its ability to catalyze the renaturation of reduced denatured RNAse (Goldberger et al., *J. Biol. Chem.* 239: 1406–1410 (1964) and Epstein et al., *Cold Spring Harbor Symp. Quant. Biol.* 28:439–449 (1963)). Protein disulfide isomerase has been shown to be a resident enzyme of the endoplasmic reticulum which is retained in the endoplasmic reticulum via a -KDEL or -HDEL amino acid sequence at its C-terminus. Protein disulfide isomerase and related proteins are further described in Laboissiere, et al., *J. Biol. Chem.*, 270(47:28006–28009 (1995); Jeenes, et al., *Gene*, 193(2): 151–156 (1997; Koivunen, et al., *Genomics*, 42(3):397–404 (1997); and Desilva, et al., *DNA Cell Biol.*, 15(1):9–16

(1996). These studies indicate the importance of the identification of protein disulfide related proteins.

More generally, the identification of all extracellular and membrane-bound proteins is of interest since they play important roles in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment, usually at a membrane-bound receptor protein.

Secreted proteins have various industrial applications, including use as pharmaceuticals, diagnostics, biosensors and bioreactors. In fact, most protein drugs available at present, such as thrombolytic agents, interferons, interleukins, erythropoietins, colony stimulating factors, and various other cytokines, are secretory proteins. Their receptors, which are membrane-bound proteins, also have potential as therapeutic or diagnostic agents. Receptor immunoadhesins, for instance, can be employed as therapeutic agents to block receptor-ligand interaction. Membrane-bound proteins can also be employed for screening of potential peptide or small molecule inhibitors of the relevant receptor/ligand interaction. Such membrane-bound proteins and cell receptors include, but are not limited to, cytokine receptors, receptor kinases, receptor phosphatases, receptors involved in cell-cell interactions, and cellular adhesin molecules like selectins and integrins. Transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Of particular interest are cellular proteins having endoplasmic reticulum (ER) retention signals. These proteins are retained in the cell and function closely with endoplasmic reticulum in protein production. Such proteins have been described previously, i.e., see Shorrosh and Dixon, *Plant J.*, 2(1):51–58 (1992).

Efforts are being undertaken by both industry and academia to identify new, native secreted and membrane-bound receptor proteins, and in particular, cellular proteins having ER retension signals. Many efforts are focused on the screening of mammalian recombinant DNA libraries to identify the coding sequences for novel secreted and membrane-bound receptor proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts, particularly the identification of novel polypeptides and nucleic acids encoding the same, which have sequence identity and similarity to protein disulfide isomerase are presented herein.

75. PRO1014

Oxygen free radicals and antioxidants appear to play an important role in the central nervous system after cerebral ischemia and reperfusion. Moreover, cardiac injury, related to ischaemia and reperfusion has been reported to be caused by the action of free radicals. Additionally, studies have reported that the redox state of the cell is a pivotal determinant of the fate of the cells. Furthermore, reactive oxygen species have been reported to be cytotoxic, causing inflammatory disease, including tissue necrosis, organ failure, atherosclerosis, infertility, birth defects, premature aging, mutations and malignancy. Thus, the control of oxidation and reduction is important for a number of reasons including for control and prevention of strokes, heart attacks, oxidative stress and hypertension. In this regard, reductases, and particularly, oxidoreductases, are of interest. Publications further describing this subject matter include Kelsey, et al., *Br. J. Cancer*, 76(7):852–4 (1997); Friedrich and Weiss, *J. Theor. Biol.*, 187(4):529–40 (1997) and Pieulle, et al., *J. Bacteriol.*, 179(18):5684–92 (1997).

In addition to reductases in particular, novel polypeptides are generally of interest. Extracellular proteins play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts, particularly those identifying polypeptides having sequence identity with reductases, and the nucleic acids encoding the same, are presented herein.

76. PRO1017

Enzymatic proteins play important roles in the chemical reactions involved in the digestion of foods, the biosynthesis of macromolecules, the controlled release and utilization of chemical energy, and other processes necessary to sustain life. Sulfotransferases are enzymes which transfer sulfate from a sulfate donor to acceptor substrates, particularly those containing terminal glucoronic acid. The HNK-1 carbohydrate epitope is expressed on several neural adhesion glycoproteins and a glycolipid, and is involved in cell interactions. The glucuronyltransferase and sulfotransferase are considered to be the key enzymes in the biosynthesis of this epitope because the rest of the structure occurs often in glycoconjugates. HNK-1 sulfotransfererase is further described in Bakker, H., et al., *J. Biol. Chem.*, 272(47): 29942–29946 (1997).

In addition to HNK-1 sulfotransfererase, and novel proteins related thereto, all novel proteins are of interest. Extracellular and membrane-bound proteins play important roles in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment, usually at a membrane-bound receptor protein.

Secreted proteins have various industrial applications, including use as pharmaceuticals, diagnostics, biosensors and bioreactors. In fact, most protein drugs available at present, such as thrombolytic agents, interferons, interleukins, erythropoietins, colony stimulating factors, and various other cytokines, are secretory proteins. Their receptors, which are membrane-bound proteins, also have potential as therapeutic or diagnostic agents. Receptor immunoadhesins, for instance, can be employed as therapeutic agents to block receptor-ligand interaction. Membrane-bound proteins can also be employed for screening of potential peptide or small molecule inhibitors of the relevant receptor/ligand interaction. Such membrane-bound proteins and cell receptors include, but are not limited to, cytokine receptors, receptor kinases, receptor phosphatases, receptors involved in cell-cell interactions, and cellular adhesin molecules like selectins and integrins. Transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Efforts are being undertaken by both industry and academia to identify new, native secreted and membrane-bound receptor proteins, particularly those having sequence identity with HNK-1 sulfotransferase. Many efforts are focused on the screening of mammalian recombinant DNA libraries to identify the coding sequences for novel secreted and membrane-bound receptor proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts are provided herein.

77. PRO474

Enzymatic proteins play important roles in the chemical reactions involved in the digestion of foods, the biosynthesis of macromolecules, the controlled release and utilization of chemical energy, and other processes necessary to sustain life. Glucose dehydrogenase functions in the oxidation of glucose to gluconate to generate metabolically useful energy. The regulation of the PQQ-linked glucose dehydrogenase in different organisms is reviewed in Neijssel, et al., *Antonie Van Leeuwenhoek*, 56(1):51–61 (1989). Glucose dehydrogenase functions as an auxiliary energy generating mechanism, because it is maximally synthesized under conditions of energy stress. In addition to molecules related to glucose dehydrogenase, all novel proteins are of interest. Extracellular and membrane-bound proteins play important roles in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment, usually at a membrane-bound receptor protein.

Secreted proteins have various industrial applications, including use as pharmaceuticals, diagnostics, biosensors and bioreactors. In fact, most protein drugs available at present, such as thrombolytic agents, interferons, interleukins, erythropoietins, colony stimulating factors, and various other cytokines, are secretory proteins. Their receptors, which are membrane-bound proteins, also have potential as therapeutic or diagnostic agents. Receptor immunoadhesins, for instance, can be employed as therapeutic agents to block receptor-ligand interaction. Membrane-bound proteins can also be employed for screening of potential peptide or small molecule inhibitors of the relevant receptor/ligand interaction. Such membrane-bound proteins and cell receptors include, but are not limited to, cytokine receptors, receptor kinases, receptor phosphatases, receptors involved in cell-cell interactions, and cellular adhesin molecules like selectins and integrins. Transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Efforts are being undertaken by both industry and academia to identify new, native secreted and membrane-bound receptor proteins, and particularly cellular proteins and those related to dehydrogenase or oxidoreductase. Many efforts are focused on the screening of mammalian recombinant DNA libraries to identify the coding sequences for novel secreted and membrane-bound receptor proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts are presented herein.

78. PRO1031

It has been reported that the cytokine interleukin 17 (IL-17) stimulates epithelial, endothelial, and fibroblastic cells to secrete cytokines such as IL-6, IL-8, and granulocyte-colony-stimulating factor, as well as prostaglandin E2. Moreover, it has been shown that when cultured in the presence of IL-17, fibroblasts could sustain proliferation of CD34+ preferential maturation into neutrophils. Thus it has been suggested that IL-17 constitutes an early initiator of the T cell-dependent inflammatory reaction and/or an element of the cytokine network that bridges the immune system to hematopoiesis. See, Yao, et al., *J. Immunol.*, 155(12):5483–5486 (1995); Fossiez, et al., *J. Exp. Med.*, 183(6):2593–2603 (1996); Kennedy, et al., *J. Interferon Cytokine Res.*, 16(8):611–617 (1996). Thus, proteins related to IL-17 are of interest.

More generally, all novel proteins are of interest. Extracellular proteins play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents.

Efforts are being undertaken by both industry and academia to identify new, native secreted proteins, particularly those related to IL-17. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.*, 93:7108–7113 (1996); U.S. Pat. No. 5,536,637)]. The results of such efforts are presented herein.

79. PRO938

Protein disulfide isomerase is an enzymatic protein which is involved in the promotion of correct refolding of proteins through the establishment of correct disulfide bond formation. Protein disulfide isomerase was initially identified based upon its ability to catalyze the renaturation of reduced denatured RNAse (Goldberger et al., *J. Biol. Chem.* 239: 1406–1410 (1964) and Epstein et al., *Cold Spring Harbor Symp. Quant. Biol.* 28:439–449 (1963)). Protein disulfide isomerase has been shown to be a resident enzyme of the endoplasmic reticulum which is retained in the endoplasmic reticulum via a -KDEL or -HDEL amino acid sequence at its C-terminus. Protein disulfide isomerase and related proteins are further described in Laboissiere, et al., *J. Biol. Chem.*, 270(47):28006–28009 (1995); Jeenes, et al., *Gene,* 193(2): 151–156 (1997); Koivunen, et al., *Genomics,* 42(3):397–404 (1997); Desilva, et al., *DNA Cell Biol.,* 15(1):9–16 (1996); Freedman, et. al. *Trends in Biochem. Sci.* 19:331–336 (1994); Bulleid, N. J. *Advances in Prot. Chem.* 44:125–50 (1993); and Noiva, R., *Prot. Exp. and Purification* 5:1–13 (1994). These studies indicate the importance of the identification of protein disulfide related proteins.

More generally, and also of interest are all novel membrane-bound proteins and receptors. Such proteins can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Given the importance of membrane bound proteins, efforts are under way to identity novel membrane bound proteins. Moreover, given the importance of disulfide bond-forming enzymes and their potential uses in a number of different applications, for example in increasing the yield of correct refolding of recombinantly produced proteins, efforts are currently being undertaken by both industry and academia to identify new, native proteins having sequence identity with protein disulfide isomerase. Many of these efforts are focused on the screening of mammalian recombinant DNA libraries to identify the coding sequences for novel protein disulfide isomerase homologs.

We herein describe the identification and characterization of a novel polypeptide having homology to protein disulfide isomerase.

80. PRO1082

The low density lipoprotein (LDL) receptor is a membrane-bound protein that plays a key role in cholesterol homeostasis, mediating cellular uptake of lipoprotein particles by high affinity binding to its ligands, apolipoprotein (apo) B-100 and apoE. The ligand-binding domain of the LDL receptor contains 7 cysteine-rich repeats of approximately 40 amino acids, wherein each repeat contains 6 cysteines, which form 3 intra-repeat disulfide bonds. These unique structural features provide the LDL receptor with its ability to specifically interact with apo B-100 and apoE, thereby allowing for transport of these lipoprotein particles across cellular membranes and metabolism of their components. Soluble fragments containing the extracellular domain of the LDL receptor have been shown to retain the ability to interact with its specific lipoprotein ligands (Simmons et al., *J. Biol. Chem.* 272:25531–25536 (1997)). LDL receptors are further described in Javitt, *FASEB J.,* 9(13): 1378–1381 (1995) and Herz and Willnow, *Ann. NY Acad. Sci.,* 737:14–19 (1994). Thus, proteins having sequence identity with LDL receptors are of interest.

More generally, all membrane-bound proteins and receptors can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor. Of particular interest are membrane bound proteins that have type II transmembrane domains.

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Efforts are thus being undertaken by both industry and academia to identify new, native proteins, particularly membrane bound proteins including type II transmembrane bound proteins. Many efforts are focused on the screening of mammalian recombinant DNA libraries to identify the coding sequences for novel receptor proteins. The results of such efforts are provided herein.

81. PRO1083

Of particular interest are membrane bound proteins that belong to the seven transmembrane (7TM) receptor superfamily. Examples of these receptors include G-protein coupled receptors such as ion receptors. Another example of a 7TM receptor superfamily member is described in Osterhoff, et al., *DNA Cell Biol.*, 16(4):379–389 (1997).

Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Efforts are being undertaken by both industry and academia to identify new, native receptor proteins. Many efforts are focused on the screening of mammalian recombinant DNA libraries to identify the coding sequences for novel receptor proteins. The results of such efforts are presented herein.

82. PRO200

Polypeptides involved in survival, proliferation and/or differentiation of cells are of interest. Polypeptides known to be involved in the survival, proliferation and/or differentiation of cells include VEGF and members of the bone morphogenetic protein family. Therefore, novel polypeptides which are related to either VEGF or the bone morphogenetic protein are of interest.

The heparin-binding endothelial cell-growth factor, VEGF, was identified and purified from media conditioned by bovine pituitary follicular or folliculo-stellate cells over several years ago. See Ferrara et al., *Biophys. Res. Comm.* 161, 851 (1989). VEGF is a naturally occurring compound that is produced in follicular or folliculo-stellate cells (FC), a morphologically well characterized population of granular cells. The FC are stellate cells that send cytoplasmic processes between secretory cells.

VEGF is expressed in a variety of tissues as multiple homodimeric forms (121, 165, 189 and 206 amino acids per monomer) resulting from alternative RNA splicing. $VEGF_{121}$ is a soluble mitogen that does not bind heparin; the longer forms of VEGF bind heparin with progressively higher affinity. The heparin-binding forms of VEGF can be cleaved in the carboxy terminus by plasmin to release (a) diffusible form(s) of VEGF. Amino acid sequencing of the carboxy terminal peptide identified after plasmin cleavage is $Arg_{110}$-$Ala_{111}$. Amino terminal "core" protein, VEGF (1–110) isolated as homodimer, binds neutralizing monoclonal antibodies (4.6.1 and 2E3) and soluble forms of FMS-like tyrosine kinase (FLT-1), kinase domain region (KDR) and fetal liver kinase (FLK) receptors with similar affinity compared to the intact $VEGF_{165}$ homodimer.

As noted, VEGF contains two domains that are responsible respectively for binding to the KDR and FLT-1 receptors. These receptors exist only on endothelial (vascular) cells. As cells become depleted in oxygen, because of trauma and the like, VEGF production increases in such cells which then bind to the respective receptors in order to signal ultimate biological effect. The signal then increases vascular permeability and the cells divide and expand to form new vascular pathways—vasculogenesis and angiogenesis.

Thus, VEGF is useful for treating conditions in which a selected action on the vascular endothelial cells, in the absence of excessive tissue growth, is important, for example, diabetic ulcers and vascular injuries resulting from trauma such as subcutaneous wounds. Being a vascular (artery and venus) endothelial cell growth factor, VEGF restores cells that are damaged, a process referred to as vasculogenesis, and stimulates the formulation of new vessels, a process referred to as angiogenesis.

VEGF would also found use in the restoration of vasculature after a myocardial infarct, as well as other uses that can be deduced. In this regard, inhibitors of VEGF are sometimes desirable, particularly to mitigate processes such as angiogenesis and vasculogenesis in cancerous cells.

Regarding the bone morphogenetic protein family, members of this family have been reported as being involved in the differentiation of cartilage and the promotion of vascularization and osteoinduction in preformed hydroxyapatite. Zou, et al., *Genes Dev. (U.S.)*, 11(17):2191 (1997); Levine, et al., *Ann. Plast. Surg.*, 39(2): 158 (1997). A number of related bone morphogenetic proteins have been identified, all members of the bone morphogenetic protein (BMP) family. Bone morphogenetic native and mutant proteins, nucleic acids encoding therefor, related compounds including receptors, host cells and uses are further described in at least: U.S. Pat. Nos. 5,670,338; 5,454,419; 5,661,007; 5,637,480; 5,631,142; 5,166,058; 5,620,867; 5,543,394; 4,877,864; 5,013,649; 55,106,748; and 5,399,677. Of particular interest are proteins having homology with bone morphogenetic protein 1, a procollagen C-proteinase that plays key roles in regulating matrix deposition.

The present invention is predicated upon research intended to identify novel polypeptides which are related to VEGF and the BMP family, and in particular, polypeptides which have a role in the survival, proliferation and/or differentiation of cells. While the novel polypeptides are not expected to have biological activity identical to the known polypeptides to which they have homology, the known polypeptide biological activities can be used to determine the relative biological activities of the novel polypeptides. In particular, the novel polypeptides described herein can be used in assays which are intended to determine the ability of a polypeptide to induce survival, proliferation or differentiation of cells. In turn, the results of these assays can be used accordingly, for diagnostic and therapeutic purposes. The results of such research is the subject of the present invention.

83. PRO285 and PRO286

The cloning of the Toll gene of *Drosophila*, a maternal effect gene that plays a central role in the establishment of the embryonic dorsal-ventral pattern, has been reported by Hashimoto et al, *Cell* 52, 269–279 (1988). The *Drosophila* Toll gene encodes an integral membrane protein with an extracytoplasmic domain of 803 amino acids and a cytoplasmic domain of 269 amino acids. The extracytoplasmic domain has a potential membrane-spanning segment, and contains multiple copies of a leucine-rich segment, a structural motif found in many transmembrane proteins. The Toll protein controls dorsal-ventral patterning in *Drosophila* embryos and activates the transcription factor Dorsal upon binding to its ligand Spätzle. (Morisato and Anderson, *Cell* 76, 677–688 (1994).) In adult *Drosophila*, the Toll/Dorsal signaling pathway participates in the anti-fungal immune response. (Lenaitre et al., *Cell* 86, 973–983 (1996).)

A human homologue of the *Drosophila* Toll protein has been described by Medzhitov et al., *Nature* 388, 394–397 (1997). This human Toll, just as *Drosophila* Toll, is a type I transmembrane protein, with an extracellular domain consisting of 21 tandemly repeated leucine-rich motifs (leucine-rich region—LRR), separated by a non-LRR region, and a cytoplasmic domain homologous to the cytoplasmic domain of the human interleukin-1 (IL-1) receptor. A constitutively active mutant of the human Toll transfected into human cell lines was shown to be able to induce the activation of NF-κB and the expression of NF-κB-controlled genes for the inflammatory cytokines IL-1, IL-6 and IL-8, as well as the expression of the constimulatory molecule B7.1, which is required for the activation of native T cells. It has been suggested that Toll functions in vertebrates as a non-clonal receptor of the immune system, which can induce signals for activating both an innate and an adaptive immune response in vertebrates. The human Toll gene reported by Medzhitov et al., supra was most strongly expressed in spleen and peripheral blood leukocytes (PBL), and the authors suggested that its expression in other tissues may be due to the presence of macrophages and dendritic cells, in which it could act as an early-warning system for infection. The public GenBank database contains the following Toll sequences: Toll1 (DNAX# HSU88540-1, which is identical with the random sequenced full-length cDNA #HUMRSC786-1); Toll2 (DNAX# HSU88878-1); Toll3 (DNAX# HSU88879-1); and Toll4 (DNAX# HSU88880-1, which is identical with the DNA sequence reported by Medzhitov et al., supra). A partial Toll sequence (Toll5) is available from GenBank under DNAX# HSU88881-1.

Further human homologues of the *Drosophila* Toll protein, designated as Toll-like receptors (huTLRs1-5) were recently cloned and shown to mirror the topographic structure of the *Drosophila* counterpart (Rock et al, *Proc. Natl. Acad. Sci. USA* 95, 588–593 [1998]). Overexpression of a constitutively active mutant of one human TLR (Toll-protein homologue—Medzhitov et al., supra; TLR4—Rock et al., supra) leads to the activation of NF-κB and induction of the inflammatory cytokines and constimulatory molecules. Medzhitov et al., supra.

84. PRO213-1, PRO1330 and PRO1449

Cancer is characterized by the increase in the number of abnormal, or neoplastic, cells derived from a normal tissue which proliferate to form a tumor mass, the invasion of adjacent tissues by these neoplastic tumor cells, and the generation of malignant cells which eventually spread via the blood or lymphatic system to regional lymph nodes and to distant sites (metastasis). In a cancerous state a cell proliferates under conditions in which normal cells would not grow. Cancer manifests itself in a wide variety of forms, characterized by different degrees of invasiveness and aggressiveness.

Alteration of gene expression is intimately related to the uncontrolled cell growth and differentiation which are a common feature of all cancers. The genomes of certain well studied tumors have been found to show decreased expression of recessive genes, usually referred to as tumor suppression genes, which would normally function to prevent malignant cell growth, and/or overexpression of certain dominant genes, such as oncogenes, that act to promote malignant growth. Each of these genetic changes appears to be responsible for importing some of the traits that, in aggregate, represent the full neoplastic phenotype (Hunter, Cell 64, 1129 [1991]; Bishop, Cell 64, 235–248 [1991]).

A well known mechanism of gene (e.g. oncogene) overexpression in cancer cells is gene amplification. This is a process where in the chromosome of the ancestral cell multiple copies of a particular gene are produced. The process involves unscheduled replication of the region of chromosome comprising the gene, followed by recombination of the replicated segments back into the chromosome (Alitalo et al., Adv. Cancer Res. 47, 235–281 [1986]). It is believed that the overexpression of the gene parallels gene amplification, i.e. is proportionate to the number of copies made.

Proto-oncogenes that encode growth factors and growth factor receptors have been identified to play important roles in the pathogenesis of various human malignancies, including breast cancer. For example, it has been found that the human ErbB2 gene (erbB2, also known as her2, or c-erbB-2), which encodes a 185-kd transmembrane glycoprotein receptor (p185HER2; HER2) related to the epidermal growth factor receptor (EGFR), is overexpressed in about 25% to 30% of human breast cancer (Slamon et al., Science 235:177–182 [1987]; Slamon et al., Science 244:707–712 [1989]).

It has been reported that gene amplification of a protooncogene is an event typically involved in the more malignant forms of cancer, and could act as a predictor of clinical outcome (Schwab et al., Genes Chromosomes Cancer 1, 181–193 [1990]; Alitalo et al., supra). Thus, erbB2 overexpression is commonly regarded as a predictor of a poor prognosis, especially in patients with primary disease that involves axillary lymph nodes (Slamon et al., [1987] and [1989], supra; Ravdin and Chamness, Gene 159:19–27 [1995]; and Hynes and Stem, Biochem Biophys Acta 1198: 165–184 [1994]), and has been linked to sensitivity and/or resistance to hormone therapy and chemotherapeutic regimens, including CMF (cyclophosphamide, methotrexate, and fluoruracil) and anthracyclines (Baselga et al., Oncology 11 (3 Suppl 1): 43–48 [1997]). However, despite the association of erbB2 overexpression with poor prognosis, the odds of HER2-positive patients responding clinically to treatment with taxanes were greater than three times those of HER2-negative patients (Ibid). A recombinant humanized anti-ErbB2 (anti-HER2) monoclonal antibody (a humanized version of the murine anti-ErbB2 antibody 4D5, referred to as rhuMAb HER2 or Herceptin 7δ) has been clinically active in patients with ErbB2-overexpressing metastatic breast cancers that had received extensive prior anticancer therapy. (Baselga et al., J. Clin. Oncol. 14:737–744 [1996]).

The protein Notch and its homologues are key regulatory receptors in determining the cell fate in various development processes. The protein Notch-4, also known as int-3 oncogene, was originally identified as a frequent target in mouse mammary tumor virus (MMVS). Notch-4 is believed to be a transgene which affects the differentiation capacity of stem cells and leads to neoplastic proliferation in epithelial cells. Shirayoshi et al., Genes Cells 2(3): 213–224 (1997). During embryogenesis, the expression of Notch-4 was detected in endothelial cells of blood vessels forming tissues such as the dorsal aorta, intersegmental vessels, yolk sac vessels, cephalic vessels, heart, vessels in branchial arches, and capillary plexuses. Notch-4 expression in these tissues was also associated with flk-1, the major regulatory gene of vasculogenesis and angiogenesis. Notch-4 is also upregulated in vitro during the differentiation of endothelial stem cell. The endothelial cell specific expression pattern of Notch-4, as well as its structural similarity to Notch suggest that Notch-4 is an endothelial cell specific homologue of Notch and that it may play a role in vaculogenesis and angiogenesis.

85. PRO298

Efforts are being undertaken by both industry and academia to identify new, native receptor proteins. Many efforts are focused on the screening of mammalian recombinant DNA libraries to identify the coding sequences for novel receptor proteins. We herein describe the identification and characterization of novel transmembrane polypeptides, designated herein as PRO298 polypeptides.

86. PRO337

Neuronal development in higher vertebrates is characterized by processes that must successfully navigate distinct cellular environment en route to their synaptic targets. The result is a functionally precise formation of neural circuits. The precision is believed to result form mechanisms that regulate growth cone pathfinding and target recognition, followed by latter refinement and remodeling of such projections by events that require neuronal activity, Goodman and Shatz, Cell/Neuron [Suppl.] 72(10): 77–98 (1993). It is further evident that different neurons extend nerve fibers that are biochemically distinct and rely on specific guidance cues provided by cell-cell, cell-matrix, and chemotrophic interactions to reach their appropriate synaptic targets, Goodman et al., supra.

One particular means by which diversity of the neuronal cell surface may be generated is through differential expression of cell surface proteins referred to as cell adhesion molecules (CAMs). Neuronally expressed CAMs have been implicated in diverse developmental processes, including migration of neurons along radial glial cells, providing permissive or repulsive substrates for neurite extension, and in promoting the selective fasciculation of axons in projectional pathways. Jessel, Neuron 1: 3–13 (1988); Edelman and Crossin, Annu. Rev. Biochem. 60: 155–190 (1991). Interactions between CAMs present on the growth cone membrane and molecules on opposing cell membranes or in the extracellular matrix are thought to provide the specific guidance cues that direct nerve fiber outgrowth along appropriate projectional pathways. Such interactions are likely to result in the activation of various second messenger systems within the growth cone that regulate neurite outgrowth. Doherty and Walsh, Curr. Opin Neurobiol. 2: 595–601 (1992).

In higher vertebrates, most neural CAMs have been found to be members of three major structural families of proteins: the integrins, the cadherins, and the immunoglobulin gene superfamily (IgSF). Jessel, supra.; Takeichi, Annu. Rev. Biochem. 59: 237–252 (1990); Reichardt and Tomaselli, Annu. Rev. Neurosci. 14: 531–570 (1991). Cell adhesion molecules of the IgSF (or Ig-CAMs), in particular, constitute a large family of proteins frequently implicated in neural cell interactions and nerve fiber outgrowth during development, Salzer and Colman, Dev. Neurosci. 11: 377–390 (1989); Brümmendorf and Rathjen, J. Neurochem. 61: 1207–1219 (1993). However, the majority of mammalian Ig-CAMs appear to be too widely expressed to specify navigational pathways or synaptic targets suggesting that other CAMs, yet to be identified, have role in these more selective interactions of neurons.

Many of the known neural Ig-CAMs have been found to be attached to the plasma membrane via a glycosylphosphatidylinositol (GPI) anchor. Additionally, many studies have implicated GPI-anchored proteins in providing specific guidance cues during the outgrowth on neurons in specific pathways. In studies of the grasshopper nervous system, treatment of embryos with phosphatidylinositol-specific phopholipase C (PIPLC), which selectively removes GPI-anchored proteins from the surfaces of cells, resulted in misdirection and faulty navigation among subsets of pioneering growth cones, as well as inhibited migratory patterns of a subset of early neurons, Chang et al., Devel. 114: 507–519 (1992). The projection of retinal fibers to the optic tectum appears to depend, in part, on a 33 kDa GPI-anchored protein, however, the precise nature of this protein is unknown. Stahl et al., Neuron 5: 735–743 (1990).

The expression of various GPI-anchored proteins has been characterized amongst the different populations of primary rat neurons amongst dorsal root ganglion, sympathetic neurons of the cervical ganglion, sympathetic neurons of the superior cervical ganglion, and cerebellar granule neurons. Rosen et al., J. Cell Biol. 117: 617–627 (1992). In contrast to the similar pattern of total membrane protein expression by these different types of neurons, striking differences were observed in the expression of GPI-anchored proteins between these neurons. Recently, a 65 kDa protein band known as neurotrimin was discovered and found to be differentially expressed by primary neurons (Rosen et al., supra), and restricted to the nervous system and found to be the most abundant and earliest expressed of the GPI-anchored species in the CNS. Struyk et al., J. Neuroscience 15(3): 2141–2156 (1995). The discovery of neurotrimin has further lead to the identification of a family of IgSF members, each containing three Ig-like domains that share significant amino acid identity, now termed IgLON. Struyk et al., supra; Pimenta et al., Gene 170(2): 189–95 (1996).

Additional members of the IgLON subfamily include opiate binding cell adhesion molecule (OBCAM), Schofield et al., EMBO J. 8: 489–495 (1989); limbic associated membrane protein (LAMP), Pimenta et al., supra; CEPU-1; GP55, Wilson et al., J. Cell Sci. 109: 3129–3138 (1996); Eur. J. Neurosci. 9(2): 334–41 (1997); and AvGp50, Hancox et al., Brain Res. Mol. Brain Res. 44(2): 273–85 (1997).

While the expression of neurotrimin appears to be widespread, it does appear to correlated with the development of several neural circuits. For example, between E18 and P10, neurotimin mRNA expression within the forebrain is maintained at high levels in neurons of the developing thalamus, cortical subplate, and cortex, particularly laminae V and VI (with less intense expression in II, II, and IV, and minimal expression in lamina I). Cortical subplate neurons may provide an early, temporary scaffold for the ingrowing thalamic afferents en route to their final synaptic targets in the cortex. Allendoerfer and Shatz, Annu. Rev. Neurosci. 17: 185–218 (1994). Conversely, subplate neurons have been suggested to be required for cortical neurons from layer V to select VI to grow into the thalamus, and neurons from layer V to select their targets in the colliculus, pons, and spinal cord (McConnell et al., J. Neurosci. 14: 1892–1907 (1994). The high level expression of neurotrimin in many of these projections suggests that it could be involved in their development.

In the hindbrain, high levels of neurotrimin message expression were observed within the pontine nucleus and by the internal granule cells and Purkinje cells of the cerebellum. The pontine nucleus received afferent input from a variety of sources including corticopontine fibers of layer V, and is a major source of afferent input, via mossy fibers, to the granule cells which, in turn, are a major source of afferent input via parallel fibers to Purkinje cells. [Palay and Chan-Palay, The cerebellar cortex: cytology and organization. New York: Springer (1974]. High level expression of neurotrimin these neurons again suggests potential involvement in the establishment of these circuits.

Neurotrimin also exhibits a graded expression pattern in the early postnatal striatum. Increased neurotrimin expression is found overlying the dorsolateral striatum of the rat, while lesser hybridization intensity is seen overlying the ventromedial striatum. Struyk et al., supra. This region of higher neurotrimin hybridization intensity does not correspond to a cytoarchitecturally differentiable region, rather it corresponds to the primary area of afferent input from layer VI of the contralateral sensoriinotor cortex (Gerfen, Nature 311: 461–464 (1984); Donoghue and Herkenham, Brain Res. 365: 397–403 (1986)). The ventromedial striatum, by contrast, receives the majority of its afferent input from the perirhinal and association cortex. It is noteworthy that a complementary graded pattern of LAMP expression, has been observed within the striatium, with highest expression in ventromedial regions, and lowest expression dorsolaterally. Levitt, Science 223: 299–301 (1985); Chesselet et al., Neuroscience 40: 725–733 (1991).

87. PRO403

Type II transmembrane proteins, also known as single pass transmembrane proteins have an N-terminal portion lodged in the cytoplasm while the C-terminal portion is exposed to the extracellular domain.

Endothelin is a family of vasoconstrictor peptides about which much activity has been focused to better understand its basic pharmacological, biochemical and molecular biological features, including the presence and structure of isopeptides and their genes (endothelin-1, -2 and û3), regulation of gene expression, intracellular processing, specific endothelin converting enzymes (ECE), receptor subtypes (ET-A and ET-B), intracellular signal transduction following receptor activation, etc.

The endothelin (ET) family of peptides have potent vascular, cardiac and renal actions which may be of pathophysiological importance in many human disease states. ET-1 is expressed as an inactive 212 amino acid prepropeptide. The prepropeptide is first cleaved at Arg52-Cys53 and Arg92-Ala93 and then the carboxy terminal Lys91 and Arg92 are trimmed from the protein to generate the propeptide big ET-1.

Endothelin is generated from inactive intermediates, the big endothelins, by a unique processing event catalyzed by the zinc metalloprotease, endothelin converting enzyme (ECE). ECE was recently cloned, and its structure was shown to be a single pass transmembrane protein with a short intracellular N-terminal and a long extracellular C-terminal that contains the catalytic domain and numerous N-glycosylation sites. ECEs cleave the endothelin propeptide between Trp73 and Val74 producing the active peptide, ET, which appears to function as a local rather than a circulating hormone (Rubanyi, G. M. & Polokoff, M. A., Pharmachological Reviews 46: 325–415(1994). Thus ECE activity is a potential site of regulation of endothelin production and a possible target for therapeutic intervention in the endothelin system. By blocking ECE activity, it is possible stop the production of ET-1 by inhibiting the conversion of the relatively inactive precursor, big ET-1, to the physiologically active form.

Endothelins may play roles in the pathophysiology of a number of disease states including: 1) cardiovascular diseases (vasospasm, hypertension, myocardial ischemia; reperfusion injury and acute myochardial infarction, stroke (cerebral ischemia), congestive heart failure, shock, atherosclerosis, vascular thickening); 2) kidney disease (acute and chronic renal failure, glomerulonephritis, cirrhosis); 3) lung disease (bronchial asthma, pulmonary hypertension); 4) gastrointestinal disorders (gastric ulcer, inflammatory bowel diseases); 5) reproductive disorders (premature labor, dysmenorhea, preeclampsia) and 6) carcinogenesis. Rubanyi & Polokoff, supra.

SUMMARY OF THE INVENTION

1. PRO213

Applicants have identified a cDNA clone that encodes a novel polypeptide, wherein the polypeptide is designated in the present application as "PRO213".

In one embodiment, the invention provides an isolated nucleic acid molecule comprising DNA encoding a PRO213 polypeptide. In one aspect, the isolated nucleic acid comprises DNA encoding the PRO213 polypeptide having amino acid residues 1 to 295 of FIG. 2 (SEQ ID NO:2), or is complementary to such encoding nucleic acid sequence, and remains stably bound to it under at least moderate, and optionally, under high stringency conditions.

In another embodiment, the invention provides isolated PRO213 polypeptide. In particular, the invention provides isolated native sequence PRO213 polypeptide, which in one embodiment, includes an amino acid sequence comprising residues 1 to 295 of FIG. 2 (SEQ ID NO:2).

2. PRO274

Applicants have identified a cDNA clone that encodes a novel polypeptide, wherein the polypeptide is designated in the present application as "PRO274".

In one embodiment, the invention provides an isolated nucleic acid molecule comprising DNA encoding a PRO274 polypeptide. In one aspect, the isolated nucleic acid comprises DNA encoding the PRO274 polypeptide having amino acid residues 1 to 492 of FIG. 4 (SEQ ID NO:7), or is complementary to such encoding nucleic acid sequence, and remains stably bound to it under at least moderate, and optionally, under high stringency conditions. The isolated nucleic acid sequence may comprise the cDNA insert of the DNA39987-1184 vector deposited on Apr. 21, 1998 as ATCC 209786 which includes the nucleotide sequence encoding PRO274.

In another embodiment, the invention provides isolated PRO274 polypeptide. In particular, the invention provides isolated native sequence PRO274 polypeptide, which in one embodiment, includes an amino acid sequence comprising residues 1 to 492 of FIG. 4 (SEQ ID NO:7). An additional embodiment of the present invention is directed to an isolated extracellular domain of a PRO274 polypeptide. Optionally, the PRO274 polypeptide is obtained or is obtainable by expressing the polypeptide encoded by the cDNA insert of the DNA39987-1184 vector deposited on Apr. 21, 1998 as ATCC 209786.

In another embodiment, the invention provides three expressed sequence tags (EST) comprising the nucleotide sequences of SEQ ID NO:8 (herein designated as DNA17873), SEQ ID NO:9 (herein designated as DNA36157) and SEQ ID NO:10 (herein designated as DNA28929) (see FIGS. 5–7, respectively).

3. PRO300

Applicants have identified a cDNA clone that encodes a novel polypeptide, wherein the polypeptide is designated in the present application as "PRO300".

In one embodiment, the invention provides an isolated nucleic acid molecule comprising DNA encoding a PRO300 polypeptide. In one aspect, the isolated nucleic acid comprises DNA encoding the PRO300 polypeptide having amino acid residues 1 to 457 of FIG. 9 (SEQ ID NO:19), or is complementary to such encoding nucleic acid sequence, and remains stably bound to it under at least moderate, and optionally, under high stringency conditions. The isolated nucleic acid sequence may comprise the cDNA insert of the DNA40625-1189 vector deposited on Apr. 21, 1998 as ATCC 209788 which includes the nucleotide sequence encoding PRO300.

In another embodiment, the invention provides isolated PRO300 polypeptide. In particular, the invention provides isolated native sequence PRO300 polypeptide, which in one embodiment, includes an amino acid sequence comprising residues 1 to 457 of FIG. 9 (SEQ ID NO:19). An additional embodiment of the present invention is directed to an isolated extracellular domain of a PRO300 polypeptide. Optionally, the PRO300 polypeptide is obtained or is obtainable by expressing the polypeptide encoded by the cDNA insert of the DNA40625-1189 vector deposited on Apr. 21, 1998 as ATCC 209788.

4. PRO284

Applicants have identified a cDNA clone that encodes a novel transmembrane polypeptide, wherein the polypeptide is designated in the present application as "PRO284".

In one embodiment, the invention provides an isolated nucleic acid molecule comprising DNA encoding a PRO284 polypeptide. In one aspect, the isolated nucleic acid comprises DNA encoding the PRO284 polypeptide having amino acid residues 1 to 285 of FIG. 11 (SEQ ID NO:28), or is complementary to such encoding nucleic acid sequence, and remains stably bound to it under at least moderate, and optionally, under high stringency conditions. In other aspects, the isolated nucleic acid comprises DNA encoding the PRO284 polypeptide having amino acid residues about 25 to 285 of FIG. 11 (SEQ ID NO:28) or 1 or about 25 to X of FIG. 11 (SEQ ID NO:28), where X is any amino acid from 71 to 80 of FIG. 11 (SEQ ID NO:28), or is complementary to such encoding nucleic acid sequence, and remains stably bound to it under at least moderate, and optionally, under high stringency conditions. The isolated nucleic acid sequence may comprise the cDNA insert of the DNA23318-1211 vector deposited on Apr. 21, 1998 as ATCC 209787 which includes the nucleotide sequence encoding PRO284.

In another embodiment, the invention provides isolated PRO284 polypeptide. In particular, the invention provides isolated native sequence PRO284 polypeptide, which in one embodiment, includes an amino acid sequence comprising residues 1 to 285 of FIG. 11 (SEQ ID NO:28). Additional embodiments of the present invention are directed to isolated PRO284 polypeptides comprising amino acids about 25 to 285 of FIG. 11 (SEQ ID NO:28) or 1 or about 25 to X of FIG. 11 (SEQ ID NO:28), where X is any amino acid from 71 to 80 of FIG. 11 (SEQ ID NO:28). Optionally, the PRO284 polypeptide is obtained or is obtainable by expressing the polypeptide encoded by the cDNA insert of the DNA23318-1211 vector deposited on Apr. 21, 1998 as ATCC 209787.

In another embodiment, the invention provides an expressed sequence tag (EST) designated herein as DNA12982 which comprises the nucleotide sequence of SEQ ID NO:29.

In another embodiment, the invention provides an expressed sequence tag (EST) designated herein as DNA15886 which comprises the nucleotide sequence of SEQ ID NO:30.

5. PRO296

Applicants have identified a cDNA clone that encodes a novel polypeptide having homology to the sarcoma-amplified protein SAS, wherein the polypeptide is designated in the present application as "PRO296".

In one embodiment, the invention provides an isolated nucleic acid molecule comprising DNA encoding a PRO296 polypeptide. In one aspect, the isolated nucleic acid comprises DNA encoding the PRO296 polypeptide having amino acid residues 1 to 204 of FIG. 15 (SEQ ID NO:36), or is complementary to such encoding nucleic acid sequence, and remains stably bound to it under at least moderate, and optionally, under high stringency conditions. In other aspects, the isolated nucleic acid comprises DNA encoding the PRO296 polypeptide having amino acid residues about 35 to 204 of FIG. 15 (SEQ ID NO:36) or amino acid 1 or about 35 to X of FIG. 15 (SEQ ID NO:36), where X is any amino acid from 42 to 51 of FIG. 15 (SEQ ID NO:36), or is complementary to such encoding nucleic acid sequence, and remains stably bound to it under at least moderate, and optionally, under high stringency conditions. The isolated nucleic acid sequence may comprise the cDNA insert of the DNA39979-1213 vector deposited on Apr. 21, 1998 as ATCC 209789 which includes the nucleotide sequence encoding PRO296.

In another embodiment, the invention provides isolated PRO296 polypeptide. In particular, the invention provides isolated native sequence PRO296 polypeptide, which in one embodiment, includes an amino acid sequence comprising residues 1 to 204 of FIG. 15 (SEQ ID NO:36). Additional embodiments of the present invention are directed to PRO296 polypeptides comprising amino acids about 35 to 204 of FIG. 15 (SEQ ID NO:36) or amino acid 1 or about 35 to X of FIG. 15 (SEQ ID NO:36), where X is any amino acid from 42 to 51 of FIG. 15 (SEQ ID NO:36). Optionally, the PRO296 polypeptide is obtained or is obtainable by expressing the polypeptide encoded by the cDNA insert of the DNA39979-1213 vector deposited on Apr. 21, 1998 as ATCC 209789.

In another embodiment, the invention provides an expressed sequence tag (EST) designated herein as DNA23020 comprising the nucleotide sequence of SEQ ID NO:37.

In another embodiment, the invention provides an expressed sequence tag (EST) designated herein as DNA21971 comprising the nucleotide sequence of SEQ ID NO:38.

In another embodiment, the invention provides an expressed sequence tag (EST) designated herein as DNA29037 comprising the nucleotide sequence of SEQ ID NO:39.

6. PRO329

Applicants have identified a cDNA clone that encodes a novel polypeptide having homology to a high affinity immunoglobulin $F_c$ receptor, wherein the polypeptide is designated in the present application as "PRO329".

In one embodiment, the invention provides an isolated nucleic acid molecule comprising DNA encoding a PRO329 polypeptide. In one aspect, the isolated nucleic acid comprises DNA encoding the PRO329 polypeptide having amino acid residues 1 to 359 of FIG. 20 (SEQ ID NO:45), or is complementary to such encoding nucleic acid sequence, and remains stably bound to it under at least moderate, and optionally, under high stringency conditions. The isolated nucleic acid sequence may comprise the cDNA insert of the DNA40594-1233 vector deposited on Feb. 5, 1998 as ATCC 209617 which includes the nucleotide sequence encoding PRO329.

In another embodiment, the invention provides isolated PRO329 polypeptide. In particular, the invention provides isolated native sequence PRO329 polypeptide, which in one embodiment, includes an amino acid sequence comprising residues 1 to 359 of FIG. 20 (SEQ ID NO:45). Optionally, the PRO329 polypeptide is obtained or is obtainable by expressing the polypeptide encoded by the cDNA insert of the DNA40594-1233 vector deposited on Feb. 5, 1998 as ATCC 209617.

7. PRO362

Applicants have identified a cDNA clone that encodes a novel polypeptide having homology to A33 antigen and HCAR membrane-bound protein, wherein the polypeptide is designated in the present application as "PRO362".

In one embodiment, the invention provides an isolated nucleic acid molecule comprising DNA encoding a PRO362 polypeptide. In one aspect, the isolated nucleic acid comprises DNA encoding the PRO362 polypeptide having amino acid residues 1 to 321 of FIG. 22 (SEQ ID NO:52), or is complementary to such encoding nucleic acid sequence, and remains stably bound to it under at least moderate, and optionally, under high stringency conditions. In another aspect, the isolated nucleic acid comprises DNA encoding the PRO362 polypeptide having amino acid residues 1 to X of FIG. 22 (SEQ ID NO:52) where X is any amino acid from amino acid 271 to 280, or is complementary to such encoding nucleic acid sequence, and remains stably bound to it under at least moderate, and optionally, under high stringency conditions. The isolated nucleic acid sequence may comprise the cDNA insert of the DNA45416-1251 vector deposited on Feb. 5, 1998 as ATCC 209620 which includes the nucleotide sequence encoding PRO362.

In another embodiment, the invention provides isolated PRO362 polypeptide. In particular, the invention provides isolated native sequence PRO362 polypeptide, which in one embodiment, includes an amino acid sequence comprising residues 1 to 321 of FIG. 22 (SEQ ID NO:52). An additional embodiment of the present invention is directed to an isolated extracellular domain of a PRO362 polypeptide comprising amino acids 1 to X of the amino acid sequence shown in FIG. 22 (SEQ ID NO:52), wherein X is any amino acid from amino acid 271 to 280. Optionally, the PRO362 polypeptide is obtained or is obtainable by expressing the polypeptide encoded by the cDNA insert of the DNA45416-1251 vector deposited on Feb. 5, 1998 as ATCC 209620.

8. PRO363

Applicants have identified a cDNA clone that encodes a novel polypeptide having homology to the cell surface receptor protein HCAR, wherein the polypeptide is designated in the present application as "PRO363".

In one embodiment, the invention provides an isolated nucleic acid molecule comprising DNA encoding a PRO363 polypeptide. In one aspect, the isolated nucleic acid comprises DNA encoding the PRO363 polypeptide having amino acid residues 1 to 373 of FIG. 24 (SEQ ID NO:59), or is complementary to such encoding nucleic acid sequence, and remains stably bound to it under at least moderate, and optionally, under high stringency conditions. In another aspect, the isolated nucleic acid comprises DNA encoding a PRO363 extracellular domain polypeptide having amino acid residues 1 to X of FIG. 24 (SEQ ID NO:59) where X is any amino acid from amino acid 216 to amino acid 225, or is complementary to such encoding nucleic acid sequence, and remains stably bound to it under at least moderate, and optionally, under high stringency conditions. The isolated nucleic acid sequence may comprise the cDNA insert of the DNA45419-1252 vector deposited on Feb. 5, 1998 as ATCC 209616 which includes the nucleotide sequence encoding PRO363.

In another embodiment, the invention provides isolated PRO363 polypeptide. In particular, the invention provides isolated native sequence PRO363 polypeptide, which in one embodiment, includes an amino acid sequence comprising residues 1 to 373 of FIG. 24 (SEQ ID NO:59). An additional embodiment of the present invention is directed to an isolated extracellular domain of a PRO363 polypeptide, wherein that extracellular domain may comprise amino acids 1 to X of the sequence shown in FIG. 24 (SEQ ID NO:59), where X is any amino acid from amino acid 216 to 225. Optionally, the PRO363 polypeptide is obtained or is obtainable by expressing the polypeptide encoded by the cDNA insert of the DNA45419-1252 vector deposited on Feb. 5, 1998 as ATCC 209616.

9. PRO868

Applicants have identified a cDNA clone that encodes a novel polypeptide having homology to tumor necrosis factor receptor, wherein the polypeptide is designated in the present application as "PRO868".

In one embodiment, the invention provides an isolated nucleic acid molecule comprising DNA encoding a PRO868 polypeptide. In one aspect, the isolated nucleic acid comprises DNA encoding the PRO868 polypeptide having amino acid residues 1 to 655 of FIG. 26 (SEQ ID NO:64), or is complementary to such encoding nucleic acid sequence, and remains stably bound to it under at least moderate, and optionally, under high stringency conditions. In another aspect, the isolated nucleic acid comprises DNA encoding the PRO868 polypeptide having amino acid 1 to X of FIG. 26 (SEQ ID NO:64), where X is any amino acid from amino acid 343 to 352 of the sequence shown in FIG. 26 (SEQ ID NO:64), or is complementary to such encoding nucleic acid sequence, and remains stably bound to it under at least moderate, and optionally, under high stringency conditions. In yet another aspect, the isolated nucleic acid comprises DNA encoding the PRO868 polypeptide having amino acid residues X to 655 of FIG. 26 (SEQ ID NO:64), where X is any amino acid from amino acid 371 to 380 of the sequence shown in FIG. 26 (SEQ ID NO:64), or is complementary to such encoding nucleic acid sequence, and remains stably bound to it under at least moderate, and optionally, under high stringency conditions. The isolated nucleic acid sequence may comprise the cDNA insert of the DNA52594-1270 vector deposited on Mar. 17, 1998 as ATCC 209679 which includes the nucleotide sequence encoding PRO868.

In another embodiment, the invention provides isolated PRO868 polypeptide. In particular, the invention provides isolated native sequence PRO868 polypeptide, which in one embodiment, includes an amino acid sequence comprising residues 1 to 655 of FIG. 26 (SEQ ID NO:64). In another aspect, the isolated PRO868 polypeptide comprises amino acid residues 1 to X of FIG. 26 (SEQ ID NO:64), where X is any amino acid from amino acid 343 to 352 of the sequence shown in FIG. 26 (SEQ ID NO:64). In yet another aspect, the PRO868 polypeptide comprises amino acid residues X to 655 of FIG. 26 (SEQ ID NO:64), where X is any amino acid from amino acid 371 to 380 of the sequence shown in FIG. 26 (SEQ ID NO:64). Optionally, the PRO868 polypeptide is obtained or is obtainable by expressing the polypeptide encoded by the cDNA insert of the DNA52594-1270 vector deposited on Mar. 17, 1998 as ATCC 209679.

10. PRO382

Applicants have identified a cDNA clone that encodes a novel polypeptide having homology to serine proteases, wherein the polypeptide is designated in the present application as "PRO382".

In one embodiment, the invention provides an isolated nucleic acid molecule comprising DNA encoding a PRO382 polypeptide. In one aspect, the isolated nucleic acid comprises DNA encoding the PRO382 polypeptide having amino acid residues 1 to 453 of FIG. 28 (SEQ ID NO:69), or is complementary to such encoding nucleic acid sequence, and remains stably bound to it under at least moderate, and optionally, under high stringency conditions. The isolated nucleic acid sequence may comprise the cDNA insert of the DNA45234-1277 vector deposited on Mar. 5, 1998 as ATCC 209654 which includes the nucleotide sequence encoding PRO382.

In another embodiment, the invention provides isolated PRO382 polypeptide. In particular, the invention provides isolated native sequence PRO382 polypeptide, which in one embodiment, includes an amino acid sequence comprising residues 1 to 453 of FIG. 28 (SEQ ID NO:69). An additional embodiment of the present invention is directed to an isolated extracellular domain of a PRO382 polypeptide, with or without the signal peptide. Optionally, the PRO382 polypeptide is obtained or is obtainable by expressing the polypeptide encoded by the cDNA insert of the DNA45234-1277 vector deposited on Mar. 5, 1998 as ATCC 209654.

11. PRO545

Applicants have identified a cDNA clone that encodes a novel polypeptide having homology to meltrin, wherein the polypeptide is designated in the present application as "PRO545".

In one embodiment, the invention provides an isolated nucleic acid molecule comprising DNA encoding a PRO545 polypeptide. In one aspect, the isolated nucleic acid comprises DNA encoding the PRO545 polypeptide having amino acid residues 1 to 735 of FIG. 30 (SEQ ID NO:74), or is complementary to such encoding nucleic acid sequence, and remains stably bound to it under at least moderate, and optionally, under high stringency conditions. The isolated nucleic acid sequence may comprise the cDNA insert of the vector deposited on Mar. 5, 1998 as ATCC 209655 which includes the nucleotide sequence encoding PRO545.

In another embodiment, the invention provides isolated PRO545 polypeptide. In particular, the invention provides isolated native sequence PRO545 polypeptide, which in one embodiment, includes an amino acid sequence comprising residues 1 to 735 of FIG. 30 (SEQ ID NO:74). An additional embodiment of the present invention is directed to an isolated extracellular domain of a PRO545 polypeptide. Optionally, the PRO545 polypeptide is obtained or is obtainable by expressing the polypeptide encoded by the cDNA insert of the vector deposited on Mar. 5, 1998 as ATCC 209655.

In another embodiment, the invention provides an expressed sequence tag (EST) designated herein as DNA13217 comprising the nucleotide sequence of SEQ ID NO:75 (FIG. 31).

12. PRO617

Applicants have identified a cDNA clone that encodes a novel polypeptide having homology to CD24, wherein the polypeptide is designated in the present application as "PRO617".

In one embodiment, the invention provides an isolated nucleic acid molecule comprising DNA encoding a PRO617 polypeptide. In one aspect, the isolated nucleic acid comprises DNA encoding the PRO617 polypeptide having amino acid residues 1 to 67 of FIG. 33 (SEQ ID NO:85), or is complementary to such encoding nucleic acid sequence, and remains stably bound to it under at least moderate, and optionally, under high stringency conditions. The isolated nucleic acid sequence may comprise the cDNA insert of the DNA48309-1280 vector deposited on Mar. 5, 1998 as ATCC 209656 which includes the nucleotide sequence encoding PRO617.

In another embodiment, the invention provides isolated PRO617 polypeptide. In particular, the invention provides isolated native sequence PRO617 polypeptide, which in one embodiment, includes an amino acid sequence comprising residues 1 to 67 of FIG. 33 (SEQ ID NO:85). Optionally, the PRO617 polypeptide is obtained or is obtainable by expressing the polypeptide encoded by the cDNA insert of the DNA48309-1280 vector deposited on Mar. 5, 1998 as ATCC 209656.

13. PRO700

Applicants have identified a cDNA clone that encodes a novel polypeptide having sequence similarity to protein disulfide isomerase, wherein the polypeptide is designated in the present application as "PRO700".

In one embodiment, the invention provides an isolated nucleic acid molecule comprising DNA encoding a PRO700 polypeptide. In one aspect, the isolated nucleic acid comprises DNA encoding the PRO700 polypeptide having amino acid residues 1 to 432 of FIG. 35 (SEQ ID NO:90), or is complementary to such encoding nucleic acid sequence, and remains stably bound to it under at least moderate, and optionally, under high stringency conditions. In another aspect, the isolated nucleic acid comprises DNA encoding the PRO700 polypeptide having amino acid residues from about 34 to 432 of FIG. 35 (SEQ ID NO:90), or is complementary to such encoding nucleic acid sequence, and remains stably bound to it under at least moderate, and optionally, under high stringency conditions. The isolated nucleic acid sequence may comprise the cDNA insert of the vector deposited on Mar. 31, 1998 as ATCC 209721 which includes the nucleotide sequence encoding PRO700.

In another embodiment, the invention provides isolated PRO700 polypeptide. In particular, the invention provides isolated native sequence PRO700 polypeptide, which in one embodiment, includes an amino acid sequence comprising residues 1 to 432 of FIG. 35 (SEQ ID NO:90). In another embodiment, the invention provides an isolated PRO700 polypeptide absent the signal sequence, which includes an amino acid sequence comprising residues from about 34 to 432 of FIG. 35 (SEQ ID NO:90). Optionally, the PRO700 polypeptide is obtained or is obtainable by expressing the polypeptide encoded by the cDNA insert of the vector deposited on Mar. 31, 1998 as ATCC 209721.

14. PRO702

Applicants have identified a cDNA clone that encodes a novel polypeptide having homology to conglutinin, wherein the polypeptide is designated in the present application as "PRO702".

In one embodiment, the invention provides an isolated nucleic acid molecule comprising DNA encoding a PRO702 polypeptide. In one aspect, the isolated nucleic acid comprises DNA encoding the PRO702 polypeptide having amino acid residues 1 to 277 of FIG. 37 (SEQ ID NO:97), or is complementary to such encoding nucleic acid sequence, and remains stably bound to it under at least moderate, and optionally, under high stringency conditions. In another aspect, the isolated nucleic acid comprises DNA encoding the PRO702 polypeptide having amino acid residues 26 to 277 of FIG. 37 (SEQ ID NO:97), or is complementary to such encoding nucleic acid sequence, and remains stably bound to it under at least moderate, and optionally, under high stringency conditions. The isolated nucleic acid sequence may comprise the cDNA insert of the DNA50980-1286 vector deposited on Mar. 31, 1998 as ATCC 209717 which includes the nucleotide sequence encoding PRO702.

In another embodiment, the invention provides isolated PRO702 polypeptide. In particular, the invention provides isolated native sequence PRO702 polypeptide, which in one embodiment, includes an amino acid sequence comprising residues 1 to 277 of FIG. 37 (SEQ ID NO:97). An additional embodiment of the present invention is directed to an isolated PRO702 polypeptide comprising amino acid residues 26 to 277 of FIG. 37 (SEQ ID NO:97). Optionally, the PRO702 polypeptide is obtained or is obtainable by expressing the polypeptide encoded by the cDNA insert of the DNA50980-1286 vector deposited on Mar. 31, 1998 as ATCC 209717.

15. PRO703

Applicants have identified a cDNA clone that encodes a novel polypeptide having sequence similarity to VLCAS, wherein the polypeptide is designated in the present application as "PRO703".

In one embodiment, the invention provides an isolated nucleic acid molecule comprising DNA encoding a PRO703 polypeptide. In one aspect, the isolated nucleic acid comprises DNA encoding the PRO703 polypeptide having amino acid residues 1 to 730 of FIG. 39 (SEQ ID NO:102), or is complementary to such encoding nucleic acid sequence, and remains stably bound to it under at least moderate, and optionally, under high stringency conditions. In another aspect, the isolated nucleic acid comprises DNA encoding the PRO703 polypeptide having amino acid residues from about 43 to 730 of FIG. 39 (SEQ ID NO:102), or is complementary to such encoding nucleic acid sequence, and remains stably bound to it under at least moderate, and optionally, under high stringency conditions. The isolated nucleic acid sequence may comprise the cDNA insert of the DNA50913-1287 vector deposited on Mar. 31, 1998 as ATCC 209716 which includes the nucleotide sequence encoding PRO703.

In another embodiment, the invention provides isolated PRO703 polypeptide. In particular, the invention provides isolated native sequence PRO703 polypeptide, which in one embodiment, includes an amino acid sequence comprising residues 1 to 730 of FIG. 39 (SEQ ID NO:102). In another embodiment, the invention provides an isolated PRO703 polypeptide absent the signal sequence, which includes an amino acid sequence comprising residues from about 43 to 730 of FIG. 30 (SEQ ID NO:102). Optionally, the PRO730 polypeptide is obtained or is obtainable by expressing the polypeptide encoded by the cDNA insert of the DNA50913-1287 vector deposited on Mar. 31, 1998 as ATCC 209716.

16. PRO705

Applicants have identified a cDNA clone that encodes a novel polypeptide having homology to K-glypican, wherein the polypeptide is designated in the present application as "PRO705".

In one embodiment, the invention provides an isolated nucleic acid molecule comprising DNA encoding a PRO705 polypeptide. In one aspect, the isolated nucleic acid comprises DNA encoding the PRO705 polypeptide having amino acid residues 1 to 555 of FIG. 41 (SEQ ID NO:109), or is complementary to such encoding nucleic acid sequence, and remains stably bound to it under at least moderate, and optionally, under high stringency conditions. In another aspect, the isolated nucleic acid comprises DNA encoding the PRO705 polypeptide having amino acid residues about 24 to 555 of FIG. 41 (SEQ ID NO:109), or is complementary to such encoding nucleic acid sequence, and remains stably bound to it under at least moderate, and optionally, under high stringency conditions. The isolated nucleic acid sequence may comprise the cDNA insert of the DNA50914-1289 vector deposited on Mar. 31, 1998 as ATCC 209722 which includes the nucleotide sequence encoding PRO705.

In another embodiment, the invention provides isolated PRO705 polypeptide. In particular, the invention provides isolated native sequence PRO705 polypeptide, which in one embodiment, includes an amino acid sequence comprising residues 1 to 555 of FIG. 41 (SEQ ID NO:109). An additional embodiment of the present invention is directed to an isolated PRO705 polypeptide comprising amino acid residues about 24 to 555 of FIG. 41 (SEQ ID NO:109). Optionally, the PRO705 polypeptide is obtained or is obtainable by expressing the polypeptide encoded by the cDNA insert of the DNA50914-1289 vector deposited on Mar. 31, 1998 as ATCC 209722.

17. PRO708

Applicants have identified a cDNA clone that encodes a novel polypeptide having homology to the aryl sulfatases, wherein the polypeptide is designated in the present application as "PRO708".

In one embodiment, the invention provides an isolated nucleic acid molecule comprising DNA encoding a PRO708 polypeptide. In one aspect, the isolated nucleic acid comprises DNA encoding the PRO708 polypeptide having amino acid residues 1 to 515 of FIG. 43 (SEQ ID NO:114), or is complementary to such encoding nucleic acid sequence, and remains stably bound to it under at least moderate, and optionally, under high stringency conditions. The isolated nucleic acid sequence may comprise the cDNA insert of the DNA48296-1292 vector deposited on Mar. 11, 1998 as ATCC 209668 which includes the nucleotide sequence encoding PRO708.

In another embodiment, the invention provides isolated PRO708 polypeptide. In particular, the invention provides isolated native sequence PRO708 polypeptide, which in one embodiment, includes an amino acid sequence comprising residues 1 to 515 of FIG. 43 (SEQ ID NO:114). Another embodiment is directed to a PRO708 polypeptide comprising residues 38–515 of the amino acid sequence shown in FIG. 43 (SEQ ID NO:114). Optionally, the PRO708 polypeptide is obtained or is obtainable by expressing the polypeptide encoded by the cDNA insert of the DNA48296-1292 vector deposited on Mar. 11, 1998 as ATCC 209668.

18. PRO320

Applicants have identified a cDNA clone that encodes a novel polypeptide having homology to fibulin, wherein the polypeptide is designated in the present application as "PRO320".

In one embodiment, the invention provides an isolated nucleic acid molecule comprising DNA encoding a PRO320 polypeptide. In one aspect, the isolated nucleic acid comprises DNA encoding the PRO320 polypeptide having amino acid residues 1 to 338 of FIG. 45 (SEQ ID NO:119), or is complementary to such encoding nucleic acid sequence, and remains stably bound to it under at least moderate, and optionally, under high stringency conditions. The isolated nucleic acid sequence may comprise the cDNA insert of the vector deposited on Mar. 11, 1998 as ATCC 209670 which includes the nucleotide sequence encoding PRO320.

In another embodiment, the invention provides isolated PRO320 polypeptide. In particular, the invention provides isolated native sequence PRO320 polypeptide, which in one embodiment, includes an amino acid sequence comprising residues 1 to 338 of FIG. 45 (SEQ ID NO:119). Optionally, the PRO320 polypeptide is obtained or is obtainable by expressing the polypeptide encoded by the cDNA insert of the vector deposited on Mar. 11, 1998 as ATCC 209670.

19. PRO324

Applicants have identified a cDNA clone that encodes a novel polypeptide having homology to oxidoreductases, wherein the polypeptide is designated in the present application as "PRO324".

In one embodiment, the invention provides an isolated nucleic acid molecule comprising DNA encoding a PRO324 polypeptide. In one aspect, the isolated nucleic acid comprises DNA encoding the PRO324 polypeptide having amino acid residues 1 to 289 of FIG. 47 (SEQ ID NO:124), or is complementary to such encoding nucleic acid sequence, and remains stably bound to it under at least moderate, and optionally, under high stringency conditions. In other aspects, the isolated nucleic acid comprises DNA encoding the PRO324 polypeptide having amino acid residues 1 or about 32 to X of FIG. 47 (SEQ ID NO:124), where X is any amino acid from 131 to 140, or is complementary to such encoding nucleic acid sequence, and remains stably bound to it under at least moderate, and optionally, under high stringency conditions. The isolated nucleic acid sequence may comprise the cDNA insert of the DNA36343-1310 vector deposited on Mar. 30, 1998 as ATCC 209718 which includes the nucleotide sequence encoding PRO324.

In another embodiment, the invention provides isolated PRO324 polypeptide. In particular, the invention provides isolated native sequence PRO324 polypeptide, which in one embodiment, includes an amino acid sequence comprising residues 1 to 289 of FIG. 47 (SEQ ID NO:124). The invention also provides isolated PRO324 polypeptide comprising residues 1 or about 32 to X of FIG. 47 (SEQ ID NO:124), wherein X is any amino acid from about 131–140. Optionally, the PRO324 polypeptide is obtained or is obtainable by expressing the polypeptide encoded by the cDNA insert of the DNA36343-1310 vector deposited on Mar. 30, 1998 as ATCC 209718.

20. PRO351

Applicants have identified a cDNA clone that encodes a novel polypeptide having sequence similarity to prostasin, wherein the polypeptide is designated in the present application as "PRO351".

In one embodiment, the invention provides an isolated nucleic acid molecule comprising DNA encoding a PRO351 polypeptide. In one aspect, the isolated nucleic acid comprises DNA encoding the PRO351 polypeptide having amino acid residues 1 to 571 of FIG. 49 (SEQ ID NO:132), or is complementary to such encoding nucleic acid sequence, and remains stably bound to it under at least moderate, and optionally, under high stringency conditions. In another aspect, the isolated nucleic acid comprises DNA encoding the PRO351 polypeptide having amino acid residues about 16 to 571 of FIG. 49 (SEQ ID NO:132), or is complementary to such encoding nucleic acid sequence, and remains stably bound to it under at least moderate, and optionally, under high stringency conditions. The isolated nucleic acid sequence may comprise the cDNA insert of the DNA40571-1315 vector deposited on Apr. 21, 1998 as ATCC 209784 which includes the nucleotide sequence encoding PRO351.

In another embodiment, the invention provides isolated PRO351 polypeptide. In particular, the invention provides isolated native sequence PRO351 polypeptide, which in one embodiment, includes an amino acid sequence comprising residues 1 to 571 of FIG. 49 (SEQ ID NO:132). In another embodiment, the invention provides an isolated PRO351 polypeptide absent the signal sequence, which includes an amino acid sequence comprising residues from about 16 to 571 of FIG. 49 (SEQ ID NO:132). Optionally, the PRO351 polypeptide is obtained or is obtainable by expressing the polypeptide encoded by the cDNA insert of the DNA40571-1315 vector deposited on Apr. 21, 1998 as ATCC 209784.

21. PRO352

Applicants have identified a cDNA clone that encodes a novel polypeptide having homology to butyrophilin, wherein the polypeptide is designated in the present application as "PRO352".

In one embodiment, the invention provides an isolated nucleic acid molecule comprising DNA encoding a PRO352 polypeptide. In one aspect, the isolated nucleic acid comprises DNA encoding the PRO352 polypeptide having amino acid residues 1 to 316 of FIG. 51 (SEQ ID NO:137), or is complementary to such encoding nucleic acid sequence, and remains stably bound to it under at least moderate, and optionally, under high stringency conditions. In other aspects, the isolated nucleic acid comprises DNA encoding the PRO352 polypeptide having amino acid residues of about 29 to 316 of FIG. 51 (SEQ ID NO:137), or 1 or about 29 to X of FIG. 51, where X is any amino acid from 246 to 255, or is complementary to such encoding nucleic acid sequence, and remains stably bound to it under at least moderate, and optionally, under high stringency conditions. The isolated nucleic acid sequence may comprise the cDNA insert of the DNA41386-1316 vector deposited on Mar. 26, 1998 as ATCC 209703 which includes the nucleotide sequence encoding PRO352.

In another embodiment, the invention provides isolated PRO352 polypeptide. In particular, the invention provides isolated native sequence PRO352 polypeptide, which in one embodiment, includes an amino acid sequence comprising residues 1 to 316 of FIG. 51 (SEQ ID NO:137). In other embodiments, the invention provides isolated PRO352 polypeptide comprising residues about 29 to 316 of FIG. 51 (SEQ ID NO:137) and 1 or about 29 to X of FIG. 51 (SEQ ID NO:137), wherein X is any amino acid from 246 to 255. Optionally, the PRO352 polypeptide is obtained or is obtainable by expressing the polypeptide encoded by the cDNA insert of the DNA41386-1316 vector deposited on Mar. 26, 1998 as ATCC 209703.

22. PRO381

Applicants have identified a cDNA clone that encodes a novel polypeptide having homology to immunophilin proteins, wherein the polypeptide is designated in the present application as "PRO381".

In one embodiment, the invention provides an isolated nucleic acid molecule comprising DNA encoding a PRO381 polypeptide. In one aspect, the isolated nucleic acid comprises DNA encoding the PRO381 polypeptide having amino acid residues 1 to 211 of FIG. 53 (SEQ ID NO:145), or is complementary to such encoding nucleic acid sequence, and remains stably bound to it under at least moderate, and optionally, under high stringency conditions. In another aspect, the isolated nucleic acid comprises DNA encoding the PRO381 polypeptide having amino acid residues about 21 to 211 of FIG. 53 (SEQ ID NO:145), or is complementary to such encoding nucleic acid sequence, and remains stably bound to it under at least moderate, and optionally, under high stringency conditions. The isolated nucleic acid sequence may comprise the cDNA insert of the DNA44194-1317 vector deposited on Apr. 28, 1998 as ATCC 209808 which includes the nucleotide sequence encoding PRO381.

In another embodiment, the invention provides isolated PRO381 polypeptide. In particular, the invention provides isolated native sequence PRO381 polypeptide, which in one embodiment, includes an amino acid sequence comprising residues 1 to 211 of FIG. 53 (SEQ ID NO:145). Another embodiment is directed to a PRO381 plypeptide comprising amino acids about 21 to 211 of FIG. 53 (SEQ ID NO:145). Optionally, the PRO381 polypeptide is obtained or is obtainable by expressing the polypeptide encoded by the cDNA insert of the DNA44194-1317 vector deposited on Apr. 28, 1998 as ATCC 209808.

23. PRO386

Applicants have identified a cDNA clone that encodes a novel polypeptide having homology to the beta-2 subunit of a sodium channel, wherein the polypeptide is designated in the present application as "PRO386".

In one embodiment, the invention provides an isolated nucleic acid molecule comprising DNA encoding a PRO386 polypeptide. In one aspect, the isolated nucleic acid comprises DNA encoding the PRO386 polypeptide having amino acid residues 1 to 215 of FIG. 55 (SEQ ID NO:150), or is complementary to such encoding nucleic acid sequence, and remains stably bound to it under at least moderate, and optionally, under high stringency conditions. In another aspect, the isolated nucleic acid comprises DNA encoding the PRO386 polypeptide having amino acid residues about 21 to 215 of FIG. 55 (SEQ ID NO:150) or 1 or about 21 to X, where X is any amino acid from 156 to 165 of FIG. 55 (SEQ ID NO:150), or is complementary to such encoding nucleic acid sequence, and remains stably bound to it under at least moderate, and optionally, under high stringency conditions. The isolated nucleic acid sequence may comprise the cDNA insert of the DNA45415-1318 vector deposited on Apr. 28, 1998 as ATCC 209810 which includes the nucleotide sequence encoding PRO386.

In another embodiment, the invention provides isolated PRO386 polypeptide. In particular, the invention provides isolated native sequence PRO386 polypeptide, which in one embodiment, includes an amino acid sequence comprising residues 1 to 215 of FIG. 55 (SEQ ID NO:150). Other embodiments of the present invention are directed to PRO386 polypeptides comprising amino acids about 21 to 215 of FIG. 55 (SEQ ID NO:150) and 1 or about 21 to X of FIG. 55 (SEQ ID NO:150), wherein X is any amino acid from 156 to 165 of FIG. 55 (SEQ ID NO:150). Optionally, the PRO386 polypeptide is obtained or is obtainable by expressing the polypeptide encoded by the cDNA insert of the DNA45415-1318 vector deposited on Apr. 28, 1998 as ATCC 209810.

In another embodiment, the invention provides an expressed sequence tag (EST) comprising the nucleotide sequence of SEQ ID NO:151 which corrsponds to an EST designated herein as DNA23350.

In another embodiment, the invention provides an expressed sequence tag (EST) comprising the nucleotide sequence of SEQ ID NO:152 which corrsponds to an EST designated herein as DNA23536.

24. PRO540

Applicants have identified a cDNA clone that encodes a novel polypeptide having sequence similarity to LCAT, wherein the polypeptide is designated in the present application as "PRO540".

In one embodiment, the invention provides an isolated nucleic acid molecule comprising DNA encoding a PRO540 polypeptide. In one aspect, the isolated nucleic acid comprises DNA encoding the PRO540 polypeptide having amino acid residues 1 to 412 of FIG. 59 (SEQ ID NO:157), or is complementary to such encoding nucleic acid sequence, and remains stably bound to it under at least moderate, and optionally, under high stringency conditions. In another aspect, the isolated nucleic acid comprises DNA encoding the PRO540 polypeptide having amino acid residues about 29 to 412 of FIG. 59 (SEQ ID NO:157), or is complementary to such encoding nucleic acid sequence, and remains stably bound to it under at least moderate, and optionally, under high stringency conditions. The isolated nucleic acid sequence may comprise the cDNA insert of the DNA44189-1322 vector deposited on Mar. 26, 1998 as ATCC 209699 which includes the nucleotide sequence encoding PRO540.

In another embodiment, the invention provides isolated PRO540 polypeptide. In particular, the invention provides isolated native sequence PRO540 polypeptide, which in one embodiment, includes an amino acid sequence comprising 1 to 412 of FIG. 59 (SEQ ID NO:157). The invention also provides isolated PRO540 polypeptide, which in one embodiment, includes an amino acid sequence comprising residues about 29 to 412 of FIG. 59 (SEQ ID NO:157). Optionally, the PRO540 polypeptide is obtained or is obtainable by expressing the polypeptide encoded by the cDNA insert of the DNA44189-1322 vector deposited on Mar. 26, 1998 as ATCC 209699.

25. PRO615

Applicants have identified a cDNA clone that encodes a novel polypeptide having sequence similarity to synaptogyrin, wherein the polypeptide is designated in the present application as "PRO615".

In one embodiment, the invention provides an isolated nucleic acid molecule comprising DNA encoding a PRO615 polypeptide. In one aspect, the isolated nucleic acid comprises DNA encoding the PRO615 polypeptide having amino acid residues 1 to 224 of FIG. 61 (SEQ ID NO:162), or is complementary to such encoding nucleic acid sequence, and remains stably bound to it under at least moderate, and optionally, under high stringency conditions. In another aspect, the isolated nucleic acid comprises DNA encoding the PRO615 polypeptide having amino acid residues X to 224 of FIG. 61 (SEQ ID NO:162), where X is any amino acid from 157 to 166, or is complementary to such encoding nucleic acid sequence, and remains stably bound to it under at least moderate, and optionally, under high stringency conditions. The isolated nucleic acid sequence may comprise the cDNA insert of the DNA48304-1323 vector deposited on Apr. 28, 1998 as ATCC 209811 which includes the nucleotide sequence encoding PRO615.

In another embodiment, the invention provides isolated PRO615 polypeptide. In particular, the invention provides isolated native sequence PRO615 polypeptide, which in one embodiment, includes an amino acid sequence comprising residues 1 to 224 of FIG. 61 (SEQ ID NO:162). An additional embodiment of the present invention is directed to an isolated extracellular domain of a PRO615 polypeptide which comprises amino acid residues X to 224 of FIG. 61 (SEQ ID NO:162), where X is any amino acid from 157 to 166 of FIG. 61 (SEQ ID NO:162). Optionally, the PRO615 polypeptide is obtained or is obtainable by expressing the polypeptide encoded by the cDNA insert of the DNA48304-1323 vector deposited on Apr. 28, 1998 as ATCC 209811.

26. PRO618

Applicants have identified a cDNA clone that encodes a novel polypeptide having sequence similarity to enteropeptidase, wherein the polypeptide is designated in the present application as "PRO618".

In one embodiment, the invention provides an isolated nucleic acid molecule comprising DNA encoding a PRO618 polypeptide. In one aspect, the isolated nucleic acid comprises DNA encoding the PRO618 polypeptide having amino acid residues 1 to 802 of FIG. 63 (SEQ ID NO:169), or is complementary to such encoding nucleic acid sequence, and remains stably bound to it under at least moderate, and optionally, under high stringency conditions. In another aspect, the isolated nucleic acid comprises DNA encoding an isolated extracellular domain of a PRO618 polypeptide having amino acid residues X to 802 of FIG. 63 (SEQ ID NO:169), where X is any amino acid from 63 to 72 of FIG. 63 (SEQ ID NO:169), or is complementary to such encoding nucleic acid sequence, and remains stably bound to it under at least moderate, and optionally, under high stringency conditions. The isolated nucleic acid sequence may comprise the cDNA insert of the DNA49152-1324 vector deposited on Apr. 28, 1998 as ATCC 209813 which includes the nucleotide sequence encoding PRO618.

In another embodiment, the invention provides isolated PRO618 polypeptide. In particular, the invention provides isolated native sequence PRO618 polypeptide, which in one embodiment, includes an amino acid sequence comprising residues 1 to 802 of FIG. 63 (SEQ ID NO:169). An additional embodiment of the present invention is directed to an isolated extracellular domain of a PRO618 polypeptide comprising amino acid X to 802 where X is any amino acid from 63 to 72 of FIG. 63 (SEQ ID NO:169). Optionally, the PRO618 polypeptide is obtained or is obtainable by expressing the polypeptide encoded by the cDNA insert of the DNA49152-1324 vector deposited on Apr. 28, 1998 as ATCC 209813.

In another embodiment, the invention provides an expressed sequence tag (EST) comprising the nucleotide sequence of SEQ ID NO:170, designated herein as DNA35597 (see FIG. 64).

27. PRO719

Applicants have identified a cDNA clone that encodes a novel polypeptide having homology to lipoprotein lipase H, wherein the polypeptide is designated in the present application as "PRO719".

In one embodiment, the invention provides an isolated nucleic acid molecule comprising DNA encoding a PRO719 polypeptide. In one aspect, the isolated nucleic acid comprises DNA encoding the PRO719 polypeptide having amino acid residues 1 to 354 of FIG. 66 (SEQ ID NO:178), or is complementary to such encoding nucleic acid sequence, and remains stably bound to it under at least moderate, and optionally, under high stringency conditions. In another aspect, the isolated nucleic acid comprises DNA encoding the PRO719 polypeptide having amino acid residues about 17 to 354 of FIG. 66 (SEQ ID NO:178), or is complementary to such encoding nucleic acid sequence, and remains stably bound to it under at least moderate, and optionally, under high stringency conditions. The isolated nucleic acid sequence may comprise the cDNA insert of the DNA49646-1327 vector deposited on Mar. 26, 1998 as ATCC 209705 which includes the nucleotide sequence encoding PRO719.

In another embodiment, the invention provides isolated PRO719 polypeptide. In particular, the invention provides isolated native sequence PRO719 polypeptide, which in one embodiment, includes an amino acid sequence comprising residues 1 to 354 of FIG. 66 (SEQ ID NO:178). In another embodiment, the invention provides isolated PRO719 polypeptide which comprises residues about 17 to 354 of FIG. 66 (SEQ ID NO:178). Optionally, the PRO719 polypeptide is obtained or is obtainable by expressing the polypeptide encoded by the cDNA insert of the DNA49646-1327 vector deposited on Mar. 26, 1998 as ATCC 209705.

28. PRO724

Applicants have identified a cDNA clone that encodes a novel polypeptide having homology to the LDL receptor, wherein the polypeptide is designated in the present application as "PRO724".

In one embodiment, the invention provides an isolated nucleic acid molecule comprising DNA encoding a PRO724 polypeptide. In one aspect, the isolated nucleic acid comprises DNA encoding the PRO724 polypeptide having amino acid residues 1 to 713 of FIG. 68 (SEQ ID NO:183), or is complementary to such encoding nucleic acid sequence, and remains stably bound to it under at least moderate, and optionally, under high stringency conditions. In another aspect, the isolated nucleic acid comprises DNA encoding a soluble PRO724 polypeptide having amino acid residues 1 to X of FIG. 68 (SEQ ID NO:183) where X is any amino acid from amino acid 437 to 446, or is complementary to such encoding nucleic acid sequence, and remains stably bound to it under at least moderate, and optionally, under high stringency conditions. The above two polypeptides may either possess or not possess the signal peptide.

The isolated nucleic acid sequence may comprise the cDNA insert of the DNA49631-1328 vector deposited on Apr. 28, 1998 as ATCC 209806 which includes the nucleotide sequence encoding PRO724.

In another embodiment, the invention provides isolated PRO724 polypeptide. In particular, the invention provides isolated native sequence PRO724 polypeptide, which in one embodiment, includes an amino acid sequence comprising residues 1 to 713 of FIG. 68 (SEQ ID NO:183). In another embodiment, the invention provides isolated soluble PRO724 polypeptide. In particular, the invention provides isolated soluble PRO724 polypeptide, which in one embodiment, includes an amino acid sequence comprising residues 1 to X of FIG. 68 (SEQ ID NO:183), where X is any amino acid from 437 to 446 of the sequence shown in FIG. 68 (SEQ ID NO:183). Optionally, the PRO724 polypeptide is obtained or is obtainable by expressing the polypeptide encoded by the cDNA insert of the DNA49631-1328 vector deposited on Apr. 28, 1998 as ATCC 209806.

29. PRO772

Applicants have identified a cDNA clone that encodes a novel polypeptide having homology to A4 protein, wherein the polypeptide is designated in the present application as "PRO772".

In one embodiment, the invention provides an isolated nucleic acid molecule comprising DNA encoding a PRO772 polypeptide. In one aspect, the isolated nucleic acid comprises DNA encoding the PRO772 polypeptide having amino acid residues 1 to 152 of FIG. 70 (SEQ ID NO:190), or is complementary to such encoding nucleic acid sequence, and remains stably bound to it under at least moderate, and optionally, under high stringency conditions. In other aspects, the isolated nucleic acid comprises DNA encoding the PRO772 polypeptide having amino acid residues 1 to X of FIG. 70 (SEQ ID NO:190), where X is any amino acid from 21 to 30 of FIG. 70 (SEQ ID NO:190), or is complementary to such encoding nucleic acid sequence, and remains stably bound to it under at least moderate, and optionally, under high stringency conditions. The isolated nucleic acid sequence may comprise the cDNA insert of the DNA49645-1347 vector deposited on Apr. 28, 1998 as ATCC 209809 which includes the nucleotide sequence encoding PRO772.

In another embodiment, the invention provides isolated PRO772 polypeptide. In particular, the invention provides isolated native sequence PRO772 polypeptide, which in one embodiment, includes an amino acid sequence comprising residues 1 to 152 of FIG. 70 (SEQ ID NO:190). Additional embodiments of the present invention are directed to PRO772 polypeptides comprising amino acids 1 to X of FIG. 70 (SEQ ID NO:190), where X is any amino acid from 21 to 30 of FIG. 70 (SEQ ID NO:190). Optionally, the PRO772 polypeptide is obtained or is obtainable by expressing the polypeptide encoded by the cDNA insert of the DNA49645-1347 vector deposited on Apr. 28, 1998 as ATCC 209809.

In another embodiment, the invention provides an expressed sequence tag (EST) designated herein as DNA43509 comprising the nucleotide sequence of SEQ ID NO:191 (FIG. 71).

30. PRO852

Applicants have identified a cDNA clone that encodes a novel polypeptide having homology to various protease enzymes, wherein the polypeptide is designated in the present application as "PRO852".

In one embodiment, the invention provides an isolated nucleic acid molecule comprising DNA encoding a PRO852 polypeptide. In one aspect, the isolated nucleic acid comprises DNA encoding the PRO852 polypeptide having amino acid residues 1 to 518 of FIG. 73 (SEQ ID NO:196), or is complementary to such encoding nucleic acid sequence, and remains stably bound to it under at least moderate, and optionally, under high stringency conditions. In other aspects, the isolated nucleic acid comprises DNA encoding the PRO852 polypeptide having amino acid residues about 21 to 518 of FIG. 73 (SEQ ID NO:196) or 1 or about 21 to X of FIG. 73 (SEQ ID NO:196) where X is any amino acid from amino acid 461 to amino acid 470 of FIG. 73 (SEQ ID NO:196), or is complementary to such encoding nucleic acid sequence, and remains stably bound to it under at least moderate, and optionally, under high stringency conditions. The isolated nucleic acid sequence may comprise the cDNA insert of the DNA45493-1349 vector deposited on Apr. 28, 1998 as ATCC 209805 which includes the nucleotide sequence encoding PRO852.

In another embodiment, the invention provides isolated PRO852 polypeptide. In particular, the invention provides isolated native sequence PRO852 polypeptide, which in one embodiment, includes an amino acid sequence comprising residues 1 to 518 of FIG. 73 (SEQ ID NO:196). In other embodiments, the PRO852 comprises amino acids about 21 to amino acid 518 of FIG. 73 (SEQ ID NO:196) or amino acids 1 or about 21 to X of FIG. 73 (SEQ ID NO:196), where X is any amino acid from amino acid 461 to amino acid 470 of FIG. 73 (SEQ ID NO:196). Optionally, the PRO852 polypeptide is obtained or is obtainable by expressing the polypeptide encoded by the cDNA insert of the DNA45493-1349 vector deposited on Apr. 28, 1998 as ATCC 209805.

31. PRO853

Applicants have identified a cDNA clone that encodes a novel polypeptide having sequence similarity to reductase, wherein the polypeptide is designated in the present application as "PRO853".

In one embodiment, the invention provides an isolated nucleic acid molecule comprising DNA encoding a PRO853 polypeptide. In one aspect, the isolated nucleic acid comprises DNA encoding the PRO853 polypeptide having amino acid residues 1 to 377 of FIG. 75 (SEQ ID NO:206), or is complementary to such encoding nucleic acid sequence, and remains stably bound to it under at least moderate, and optionally, under high stringency conditions. In another aspect, the isolated nucleic acid comprises DNA encoding the PRO853 polypeptide having amino acid residues about 17 to 377 of FIG. 75 (SEQ ID NO:206), or is complementary to such encoding nucleic acid sequence, and remains stably bound to it under at least moderate, and optionally, under high stringency conditions. The isolated nucleic acid sequence may comprise the cDNA insert of the DNA48227-1350 vector deposited on Apr. 28, 1998 as ATCC 209812 which includes the nucleotide sequence encoding PRO853.

In another embodiment, the invention provides isolated PRO853 polypeptide. In particular, the invention provides isolated native sequence PRO853 polypeptide, which in one embodiment, includes an amino acid sequence comprising residues 1 to 377 of FIG. 75 (SEQ ID NO:206). In another embodiment, the invention provides an isolated PRO853 polypeptide absent the signal sequence, which includes an amino acid sequence comprising residues from about 17 to 377 of FIG. 75 (SEQ ID NO:206). Optionally, the PRO853 polypeptide is obtained or is obtainable by expressing the polypeptide encoded by the cDNA insert of the DNA48227-1350 vector deposited on Apr. 28, 1998 as ATCC 209812.

32. PRO860

Applicants have identified a cDNA clone that encodes a novel polypeptide having sequence similarity to neurofascin, wherein the polypeptide is designated in the present application as "PRO860".

In one embodiment, the invention provides an isolated nucleic acid molecule comprising DNA encoding a PRO860 polypeptide. In one aspect, the isolated nucleic acid comprises DNA encoding the PRO860 polypeptide having amino acid residues 1 to 985 of FIG. 77 (SEQ ID NO:211), or is complementary to such encoding nucleic acid sequence, and remains stably bound to it under at least moderate, and optionally, under high stringency conditions. In another aspect, the isolated nucleic acid comprises DNA encoding the PRO860 polypeptide having amino acid residues 1 to X of FIG. 77 (SEQ ID NO:211), where X is any amino acid from 443–452 of FIG. 77 (SEQ ID NO:211), or is complementary to such encoding nucleic acid sequence, and remains stably bound to it under at least moderate, and optionally, under high stringency conditions. The isolated nucleic acid sequence may comprise the cDNA insert of the DNA41404-1352 vector deposited on May 6, 1998 as ATCC 209844 which includes the nucleotide sequence encoding PRO860.

In another embodiment, the invention provides isolated PRO860 polypeptide. In particular, the invention provides isolated native sequence PRO860 polypeptide, which in one embodiment, includes an amino acid sequence comprising residues 1 to 985 of FIG. 77 (SEQ ID NO:211). In another embodiment, the invention provides an isolated PRO860 polypeptide which includes an amino acid sequence comprising residues 1 to X of FIG. 77 (SEQ ID NO:211), where X is any amino acid residue from 443 to 452 of FIG. 77 (SEQ ID NO:211). Optionally, the PRO860 polypeptide is obtained or is obtainable by expressing the polypeptide encoded by the cDNA insert of the DNA41404-1352 vector deposited on May 6, 1998 as ATCC 209844.

33. PRO846

Applicants have identified a cDNA clone that encodes a novel polypeptide having sequence similarity to CMRF35, wherein the polypeptide is designated in the present application as "PRO846".

In one embodiment, the invention provides an isolated nucleic acid molecule comprising DNA encoding a PRO846 polypeptide. In one aspect, the isolated nucleic acid comprises DNA encoding the PRO846 polypeptide having amino acid residues 1 to 332 of FIG. 79 (SEQ ID NO:216), or is complementary to such encoding nucleic acid sequence, and remains stably bound to it under at least moderate, and optionally, under high stringency conditions. In other aspects, the isolated nucleic acid comprises DNA encoding the PRO846 polypeptide having amino acid residues about 18 to 332 of FIG. 79 (SEQ ID NO:216) or 1 or about 18 to X of SEQ ID NO:216, where X is any amino acid from 243 to 252 of FIG. 79 (SEQ ID NO:216), or is complementary to such encoding nucleic acid sequence, and remains stably bound to it under at least moderate, and optionally, under high stringency conditions. The isolated nucleic acid sequence may comprise the cDNA insert of the DNA44196-1353 vector deposited on May 6, 1998 as ATCC 209847 which includes the nucleotide sequence encoding PRO846.

In another embodiment, the invention provides isolated PRO846 polypeptide. In particular, the invention provides isolated native sequence PRO846 polypeptide, which in one embodiment, includes an amino acid sequence comprising residues 1 to 332 of FIG. 79 (SEQ ID NO:216). In other embodiments, the invention provides an isolated PRO846 polypeptide absent the signal sequence, which includes an amino acid sequence comprising residues from about 18 to 332 of FIG. 79 (SEQ ID NO:216). Additional embodiments of the present invention are directed to an isolated PRO846 polypeptide comprising amino acid 1 or about 18 to X of FIG. 79 (SEQ ID NO:216), where X is any amino acid from 243 to 252 of FIG. 79 (SEQ ID NO:216). Optionally, the PRO846 polypeptide is obtained or is obtainable by expressing the polypeptide encoded by the cDNA insert of the DNA44196-1353 vector deposited on May 6, 1998 as ATCC 209847.

34. PRO862

Applicants have identified a cDNA clone that encodes a novel polypeptide having sequence similarity to lysozyme, wherein the polypeptide is designated in the present application as "PRO862".

In one embodiment, the invention provides an isolated nucleic acid molecule comprising DNA encoding a PRO862 polypeptide. In one aspect, the isolated nucleic acid comprises DNA encoding the PRO862 polypeptide having amino acid residues 1 to 146 of FIG. 81 (SEQ ID NO:221), or is complementary to such encoding nucleic acid sequence, and remains stably bound to it under at least moderate, and optionally, under high stringency conditions. In another aspect, the isolated nucleic acid comprises DNA encoding the PRO862 polypeptide having amino acid residues about 19 to 146 of FIG. 81 (SEQ ID NO:221), or is complementary to such encoding nucleic acid sequence, and remains stably bound to it under at least moderate, and optionally, under high stringency conditions. The isolated nucleic acid sequence may comprise the cDNA insert of the DNA52187-1354 vector deposited on May 6, 1998 as ATCC 209845 which includes the nucleotide sequence encoding PRO862.

In another embodiment, the invention provides isolated PRO862 polypeptide. In particular, the invention provides isolated native sequence PRO862 polypeptide, which in one embodiment, includes an amino acid sequence comprising residues 1 to 146 of FIG. 81 (SEQ ID NO:221). In another embodiment, the invention provides an isolated PRO862 polypeptide absent the signal sequence, which includes an amino acid sequence comprising residues from about 19 to 146 of FIG. 81 (SEQ ID NO:221). Optionally, the PRO862 polypeptide is obtained or is obtainable by expressing the polypeptide encoded by the cDNA insert of the DNA52187-1354 vector deposited on May 6, 1998 as ATCC 209845.

35. PRO864

Applicants have identified a cDNA clone that encodes a novel polypeptide having sequence similarity to Wnt-4, wherein the polypeptide is designated in the present application as "PRO864".

In one embodiment, the invention provides an isolated nucleic acid molecule comprising DNA encoding a PRO864 polypeptide. In one aspect, the isolated nucleic acid comprises DNA encoding the PRO864 polypeptide having amino acid residues 1 to 351 of FIG. 83 (SEQ ID NO:226), or is complementary to such encoding nucleic acid sequence, and remains stably bound to it under at least moderate, and optionally, under high stringency conditions. In another aspect, the isolated nucleic acid comprises DNA encoding the PRO864 polypeptide having amino acid residues about 23 to 351 of FIG. 83 (SEQ ID NO:226), or is complementary to such encoding nucleic acid sequence, and remains stably bound to it under at least moderate, and optionally, under high stringency conditions. The isolated nucleic acid sequence may comprise the cDNA insert of the DNA48328-1355 vector deposited on May 6, 1998 as ATCC 209843 which includes the nucleotide sequence encoding PRO864.

In another embodiment, the invention provides isolated PRO864 polypeptide. In particular, the invention provides isolated native sequence PRO864 polypeptide, which in one embodiment, includes an amino acid sequence comprising residues 1 to 351 of FIG. 83 (SEQ ID NO:226). In another embodiment, the invention provides an isolated PRO864 polypeptide absent the signal sequence, which includes an amino acid sequence comprising residues from about 23 to 351 of FIG. 83 (SEQ ID NO:226). Optionally, the PRO864 polypeptide is obtained or is obtainable by expressing the polypeptide encoded by the cDNA insert of the DNA48328-1355 vector deposited on May 6, 1998 as ATCC 209843.

36. PRO792

Applicants have identified a cDNA clone that encodes a novel polypeptide having homology to CD23, wherein the polypeptide is designated in the present application as "PRO792".

In one embodiment, the invention provides an isolated nucleic acid molecule comprising DNA encoding a PRO792 polypeptide. In one aspect, the isolated nucleic acid comprises DNA encoding the PRO792 polypeptide having amino acid residues 1 to 293 of FIG. 85 (SEQ ID NO:231), or is complementary to such encoding nucleic acid sequence, and remains stably bound to it under at least moderate, and optionally, under high stringency conditions. In another aspect, the isolated nucleic acid comprises DNA encoding the PRO792 polypeptide having amino acid residues X to 293 of FIG. 85 (SEQ ID NO:231) where X is any amino acid from 50 to 59 of FIG. 85 (SEQ ID NO:231), or is complementary to such encoding nucleic acid sequence, and remains stably bound to it under at least moderate, and optionally, under high stringency conditions. The isolated nucleic acid sequence may comprise the cDNA insert of the DNA56352-1358 vector deposited on May 6, 1998 as ATCC 209846 which includes the nucleotide sequence encoding PRO792.

In another embodiment, the invention provides isolated PRO792 polypeptide. In particular, the invention provides isolated native sequence PRO792 polypeptide, which in one embodiment, includes an amino acid sequence comprising residues 1 to 293 of FIG. 85 (SEQ ID NO:231). An additional embodiment of the present invention is directed to PRO792 polypeptide comprising amino acids X to 293 of FIG. 85 (SEQ ID NO:231), where X is any amino acid from 50 to 59 of FIG. 85 (SEQ ID NO:231). Optionally, the PRO792 polypeptide is obtained or is obtainable by expressing the polypeptide encoded by the cDNA insert of the DNA56352-1358 vector deposited on May 6, 1998 as ATCC 209846.

37. PRO866

Applicants have identified a cDNA clone that encodes a novel polypeptide having homology to mindin and spondin proteins, wherein the polypeptide is designated in the present application as "PRO866".

In one embodiment, the invention provides an isolated nucleic acid molecule comprising DNA encoding a PRO866 polypeptide. In one aspect, the isolated nucleic acid comprises DNA encoding the PRO866 polypeptide having amino acid residues 1 to 331 of FIG. 87 (SEQ ID NO:236), or is complementary to such encoding nucleic acid sequence, and remains stably bound to it under at least moderate, and optionally, under high stringency conditions. In another aspect, the isolated nucleic acid comprises DNA encoding the PRO866 polypeptide having amino acid residues about 27 to 229 of FIG. 87 (SEQ ID NO:236), or is complementary to such encoding nucleic acid sequence, and remains stably bound to it under at least moderate, and optionally, under high stringency conditions. The isolated nucleic acid sequence may comprise the cDNA insert of the DNA53971-1359 vector deposited on Apr. 7, 1998 as ATCC 209750 which includes the nucleotide sequence encoding PRO866.

In another embodiment, the invention provides isolated PRO866 polypeptide. In particular, the invention provides isolated native sequence PRO866 polypeptide, which in one embodiment, includes an amino acid sequence comprising residues 1 to 331 of FIG. 87 (SEQ ID NO:236). Another embodiment of the present invention is directed to PRO866 polypeptides comprising amino acids about 27 to 331 of FIG. 87 (SEQ ID NO:236). Optionally, the PRO866 polypeptide is obtained or is obtainable by expressing the polypeptide encoded by the cDNA insert of the DNA53971-1359 vector deposited on Apr. 7, 1998 as ATCC 209750.

38. PRO871

Applicants have identified a cDNA clone that encodes a novel polypeptide having homology to CyP-60, wherein the polypeptide is designated in the present application as "PRO871".

In one embodiment, the invention provides an isolated nucleic acid molecule comprising DNA encoding a PRO871 polypeptide. In one aspect, the isolated nucleic acid comprises DNA encoding the PRO871 polypeptide having amino acid residues 1 to 472 of FIG. 89 (SEQ ID NO:245), or is complementary to such encoding nucleic acid sequence, and remains stably bound to it under at least moderate, and optionally, under high stringency conditions. In other aspects, the isolated nucleic acid comprises DNA encoding the PRO871 polypeptide having amino acid residues about 22 to 472 of FIG. 89 (SEQ ID NO:245), or is complementary to such encoding nucleic acid sequence, and remains stably bound to it under at least moderate, and optionally, under high stringency conditions. The isolated nucleic acid sequence may comprise the cDNA insert of the DNA50919-1361 vector deposited on May 6, 1998 as ATCC 209848 which includes the nucleotide sequence encoding PRO871.

In another embodiment, the invention provides isolated PRO871 polypeptide. In particular, the invention provides isolated native sequence PRO871 polypeptide, which in one embodiment, includes an amino acid sequence comprising residues 1 to 472 of FIG. 89 (SEQ ID NO:245). An additional embodiment of the present invention is directed to PRO871 polypeptides comprising amino acids about 22 to 472 of FIG. 89 (SEQ ID NO:245). Optionally, the PRO871 polypeptide is obtained or is obtainable by expressing the polypeptide encoded by the cDNA insert of the DNA50919-1361 vector deposited on May 6, 1998 as ATCC 209848.

39. PRO873

Applicants have identified a cDNA clone that encodes a novel polypeptide having homology to carboxylesterase, wherein the polypeptide is designated in the present application as "PRO873".

In one embodiment, the invention provides an isolated nucleic acid molecule comprising DNA encoding a PRO873 polypeptide. In one aspect, the isolated nucleic acid comprises DNA encoding the PRO873 polypeptide having amino acid residues 1 to 545 of FIG. 91 (SEQ ID NO:254), or is complementary to such encoding nucleic acid sequence, and remains stably bound to it under at least moderate, and optionally, under high stringency conditions. In other aspects, the isolated nucleic acid comprises DNA encoding the PRO873 polypeptide having amino acid residues about 30 to about 545 of FIG. 91 (SEQ ID NO:254), or is complementary to such encoding nucleic acid sequence, and remains stably bound to it under at least moderate, and optionally, under high stringency conditions. The isolated nucleic acid sequence may comprise the cDNA insert of the DNA44179-1362 vector deposited on May 6, 1998 as ATCC 209851 which includes the nucleotide sequence encoding PRO873.

In another embodiment, the invention provides isolated PRO873 polypeptide. In particular, the invention provides isolated native sequence PRO873 polypeptide, which in one embodiment, includes an amino acid sequence comprising residues 1 to 545 of FIG. 91 (SEQ ID NO:254). Additional embodiments of the present invention are directed to PRO873 polypeptides comprising amino acids about 30 to about 545 of FIG. 91 (SEQ ID NO:254). Optionally, the PRO873 polypeptide is obtained or is obtainable by expressing the polypeptide encoded by the cDNA insert of the DNA44179-1362 vector deposited on May 6, 1998 as ATCC 209851.

40. PRO940

Applicants have identified a cDNA clone that encodes a novel polypeptide having homology to CD33 and OB binding protein-2, wherein the polypeptide is designated in the present application as "PRO940".

In one embodiment, the invention provides an isolated nucleic acid molecule comprising DNA encoding a PRO940 polypeptide. In one aspect, the isolated nucleic acid comprises DNA encoding the PRO940 polypeptide having amino acid residues 1 to 544 of FIG. 93 (SEQ ID NO:259), or is complementary to such encoding nucleic acid sequence, and remains stably bound to it under at least moderate, and optionally, under high stringency conditions. In other aspects, the isolated nucleic acid comprises DNA encoding the PRO940 polypeptide having amino acid residues about 16 to 544 of FIG. 93 (SEQ ID NO:259) or 1 or about 16 to X of FIG. 93 (SEQ ID NO:259), where X is any amino acid from 394 to 403 of FIG. 93 (SEQ ID NO:259), or is complementary to such encoding nucleic acid sequence, and remains stably bound to it under at least moderate, and optionally, under high stringency conditions. The isolated nucleic acid sequence may comprise the cDNA insert of the DNA54002-1367 vector deposited on Apr. 7, 1998 as ATCC 209754 which includes the nucleotide sequence encoding PRO940.

In another embodiment, the invention provides isolated PRO940 polypeptide. In particular, the invention provides isolated native sequence PRO940 polypeptide, which in one embodiment, includes an amino acid sequence comprising residues 1 to 544 of FIG. 93 (SEQ ID NO:259). Other embodiments of the present invention are directed to PRO940 polypeptides comprising amino acids about 16 to 544 of FIG. 93 (SEQ ID NO:259) or 1 or about 16 to X of FIG. 93 (SEQ ID NO:259), where X is any amino acid from 394 to 403 of FIG. 93 (SEQ ID NO:259). Optionally, the PRO940 polypeptide is obtained or is obtainable by expressing the polypeptide encoded by the cDNA insert of the DNA54002-1367 vector deposited on Apr. 7, 1998 as ATCC 209754.

41. PRO941

Applicants have identified a cDNA clone that encodes a novel polypeptide having homology to a cadherin protein, wherein the polypeptide is designated in the present application as "PRO941".

In one embodiment, the invention provides an isolated nucleic acid molecule comprising DNA encoding a PRO941 polypeptide. In one aspect, the isolated nucleic acid comprises DNA encoding the PRO941 polypeptide having amino acid residues 1 to 772 of FIG. 95 (SEQ ID NO:264), or is complementary to such encoding nucleic acid sequence, and remains stably bound to it under at least moderate, and optionally, under high stringency conditions. In other aspects, the isolated nucleic acid comprises DNA encoding the PRO941 polypeptide having amino acid residues about 22 to 772 of FIG. 95 (SEQ ID NO:264) or 1 or about 22 to X of FIG. 95 (SEQ ID NO:264), where X is any amino acid from 592 to 601 FIG. 95 (SEQ ID NO:264), or is complementary to such encoding nucleic acid sequence, and remains stably bound to it under at least moderate, and optionally, under high stringency conditions. The isolated nucleic acid sequence may comprise the cDNA insert of the DNA53906-1368 vector deposited on Apr. 7, 1998 as ATCC 209747 which includes the nucleotide sequence encoding PRO941.

In another embodiment, the invention provides isolated PRO941 polypeptide. In particular, the invention provides isolated native sequence PRO941 polypeptide, which in one embodiment, includes an amino acid sequence comprising residues 1 to 772 of FIG. 95 (SEQ ID NO:264). Additional embodiments of the present invention are directed to PRO941 polypeptides which comprise amino acid about 21 to 772 of FIG. 95 (SEQ ID NO:264) or 1 or about 22 X of FIG. 95 (SEQ ID NO:264), where X is any amino acid from 592 to 601 of FIG. 95 (SEQ ID NO:264). Optionally, the PRO941 polypeptide is obtained or is obtainable by expressing the polypeptide encoded by the cDNA insert of the DNA53906-1368 vector deposited on Apr. 7, 1998 as ATCC 209747.

In another embodiment, the invention provides an expressed sequence tag (EST) designated herein as DNA6415 comprising the nucleotide sequence of FIG. 96 (SEQ ID NO:265).

42. PRO944

Applicants have identified a cDNA clone that encodes a novel polypeptide having homology to Clostridium perfringens enterotoxin receptor (CPE-R), wherein the polypeptide is designated in the present application as "PRO944".

In one embodiment, the invention provides an isolated nucleic acid molecule comprising DNA encoding a PRO944 polypeptide. In one aspect, the isolated nucleic acid comprises DNA encoding the PRO944 polypeptide having amino acid residues 1 to 211 of FIG. 98 (SEQ ID NO:270), or is complementary to such encoding nucleic acid sequence, and remains stably bound to it under at least moderate, and optionally, under high stringency conditions. In other aspects, the isolated nucleic acid comprises DNA encoding the PRO944 polypeptide having amino acid residues about 22 to 229 of FIG. 98 (SEQ ID NO:270) or amino acid 1 or about 22 to X of FIG. 98 (SEQ ID NO:270) where X is any amino acid from 77 to 80 of FIG. 98 (SEQ ID NO:270), or is complementary to such encoding nucleic acid sequence, and remains stably bound to it under at least moderate, and optionally, under high stringency conditions. The isolated nucleic acid sequence may comprise the cDNA insert of the DNA52185-1370 vector deposited on May 14, 1998 as ATCC 209861 which includes the nucleotide sequence encoding PRO944.

In another embodiment, the invention provides isolated PRO944 polypeptide. In particular, the invention provides isolated native sequence PRO944 polypeptide, which in one embodiment, includes an amino acid sequence comprising residues 1 to 211 of FIG. 98 (SEQ ID NO:270). Additional embodiments of the present invention are directed to PRO944 polypeptides comprising amino acids about 22 to 211 of FIG. 98 (SEQ ID NO:270) or amino acid 1 or about 22 to X of FIG. 98 (SEQ ID NO:270), where X is any amino acid from 77 to 86 of FIG. 98 (SEQ ID NO:270). Optionally, the PRO944 polypeptide is obtained or is obtainable by expressing the polypeptide encoded by the cDNA insert of the DNA52185-1370 vector deposited on May 14, 1998 as ATCC 209861.

In another embodiment, the invention provides an expressed sequence tag (EST) designated herein as DNA14007 comprising the nucleotide sequence of FIG. 99 (SEQ ID NO:271).

In another embodiment, the invention provides an expressed sequence tag (EST) designated herein as DNA12733 comprising the nucleotide sequence of FIG. 100 (SEQ ID NO:272).

In another embodiment, the invention provides an expressed sequence tag (EST) designated herein as DNA12746 comprising the nucleotide sequence of FIG. 101 (SEQ ID NO:273).

In another embodiment, the invention provides an expressed sequence tag (EST) designated herein as DNA12834 comprising the nucleotide sequence of FIG. 102 (SEQ ID NO:274).

In another embodiment, the invention provides an expressed sequence tag (EST) designated herein as DNA12846 comprising the nucleotide sequence of FIG. 103 (SEQ ID NO:275).

In another embodiment, the invention provides an expressed sequence tag (EST) designated herein as DNA13104 comprising the nucleotide sequence of FIG. 104 (SEQ ID NO:276).

In another embodiment, the invention provides an expressed sequence tag (EST) designated herein as DNA13259 comprising the nucleotide sequence of FIG. 105 (SEQ ID NO:277).

In another embodiment, the invention provides an expressed sequence tag (EST) designated herein as DNA13959 comprising the nucleotide sequence of FIG. 106 (SEQ ID NO:278).

In another embodiment, the invention provides an expressed sequence tag (EST) designated herein as DNA13961 comprising the nucleotide sequence of FIG. 107 (SEQ ID NO:279).

43. PRO983

Applicants have identified a cDNA clone that encodes a novel polypeptide having homology to a vesicle associated protein, VAP-33, wherein the polypeptide is designated in the present application as "PRO983".

In one embodiment, the invention provides an isolated nucleic acid molecule comprising DNA encoding a PRO983 polypeptide. In one aspect, the isolated nucleic acid comprises DNA encoding the PRO983 polypeptide having amino acid residues 1 to 243 of FIG. 109 (SEQ ID NO:284), or is complementary to such encoding nucleic acid sequence, and remains stably bound to it under at least moderate, and optionally, under high stringency conditions.

In other aspects, the isolated nucleic acid comprises DNA encoding the PRO983 polypeptide having amino acid residue 1 to X of FIG. 109 (SEQ ID NO:284) where X is any amino acid from 219 to 228 of FIG. 109 (SEQ ID NO:284), or is complementary to such encoding nucleic acid sequence, and remains stably bound to it under at least moderate, and optionally, under high stringency conditions. The isolated nucleic acid sequence may comprise the cDNA insert of the DNA53977-1371 vector deposited on May 14, 1998 as ATCC 209862 which includes the nucleotide sequence encoding PRO983.

In another embodiment, the invention provides isolated PRO983 polypeptide. In particular, the invention provides isolated native sequence PRO983 polypeptide, which in one embodiment, includes an amino acid sequence comprising residues 1 to 243 of FIG. 109 (SEQ ID NO:284). Additional embodiments of the present invention are directed to PRO983 polypeptides comprising amino acid 1 to X of FIG. 109 (SEQ ID NO:284), where X is any amino acid from 219 to 228 of FIG. 109 (SEQ ID NO:284). Optionally, the PRO983 polypeptide is obtained or is obtainable by expressing the polypeptide encoded by the cDNA insert of the DNA53977-1371 vector deposited on May 14, 1998 as ATCC 209862.

In another embodiment, the invention provides an expressed sequence tag (EST) designated herein as DNA17130 comprising the nucleotide sequence of FIG. 110 (SEQ ID NO:285).

In another embodiment, the invention provides an expressed sequence tag (EST) designated herein as DNA23466 comprising the nucleotide sequence of FIG. 111 (SEQ ID NO:286).

In another embodiment, the invention provides an expressed sequence tag (EST) designated herein as DNA26818 comprising the nucleotide sequence of FIG. 112 (SEQ ID NO:287).

In another embodiment, the invention provides an expressed sequence tag (EST) designated herein as DNA37618 comprising the nucleotide sequence of FIG. 113 (SEQ ID NO:288).

In another embodiment, the invention provides an expressed sequence tag (EST) designated herein as DNA41732 comprising the nucleotide sequence of FIG. 114 (SEQ ID NO:289).

In another embodiment, the invention provides an expressed sequence tag (EST) designated herein as DNA45980 comprising the nucleotide sequence of FIG. 115 (SEQ ID NO:290).

In another embodiment, the invention provides an expressed sequence tag (EST) designated herein as DNA46372 comprising the nucleotide sequence of FIG. 116 (SEQ ID NO:291).

44. PRO1057

Applicants have identified a cDNA clone that encodes a novel polypeptide having homology to proteases, wherein the polypeptide is designated in the present application as "PRO1057".

In one embodiment, the invention provides an isolated nucleic acid molecule comprising DNA encoding a PRO1057 polypeptide. In one aspect, the isolated nucleic acid comprises DNA encoding the PRO1057 polypeptide having amino acid residues 1 to 413 of FIG. 118 (SEQ ID NO:296), or is complementary to such encoding nucleic acid sequence, and remains stably bound to it under at least moderate, and optionally, under high stringency conditions. In other aspects, the isolated nucleic acid comprises DNA encoding the PRO1057 polypeptide having amino acid residues about 17 to 413 of FIG. 118 (SEQ ID NO:296), or is complementary to such encoding nucleic acid sequence, and remains stably bound to it under at least moderate, and optionally, under high stringency conditions. The isolated nucleic acid sequence may comprise the cDNA insert of the DNA57253-1382 vector deposited on May 14, 1998 as ATCC 209867 which includes the nucleotide sequence encoding PRO1057.

In another embodiment, the invention provides isolated PRO1057 polypeptide. In particular, the invention provides isolated native sequence PRO1057 polypeptide, which in one embodiment, includes an amino acid sequence comprising residues 1 to 413 of FIG. 118 (SEQ ID NO:296). Additional embodiments of the present invention are directed to PRO1057 polypeptides comprising amino acids about 17 to 413 of FIG. 118 (SEQ ID NO:296). Optionally, the PRO1057 polypeptide is obtained or is obtainable by expressing the polypeptide encoded by the cDNA insert of the DNA57253-1382 vector deposited on May 14, 1998 as ATCC 209867.

45. PRO1071

Applicants have identified a cDNA clone that encodes a novel polypeptide having homology to thrombospondin, wherein the polypeptide is designated in the present application as "PRO1071".

In one embodiment, the invention provides an isolated nucleic acid molecule comprising DNA encoding a PRO1071 polypeptide. In one aspect, the isolated nucleic acid comprises DNA encoding the PRO1071 polypeptide having amino acid residues 1 to 525 of FIG. 120 (SEQ ID NO:301), or is complementary to such encoding nucleic acid sequence, and remains stably bound to it under at least moderate, and optionally, under high stringency conditions. In other aspects, the isolated nucleic acid comprises DNA encoding the PRO1071 polypeptide having amino acid residues about 26 to 525 of FIG. 120 (SEQ ID NO:301), or is complementary to such encoding nucleic acid sequence, and remains stably bound to it under at least moderate, and optionally, under high stringency conditions. The isolated nucleic acid sequence may comprise the cDNA insert of the DNA58847-1383 vector deposited on May 20, 1998 as ATCC 209879 which includes the nucleotide sequence encoding PRO1071.

In another embodiment, the invention provides isolated PRO1071 polypeptide. In particular, the invention provides isolated native sequence PRO1071 polypeptide, which in one embodiment, includes an amino acid sequence comprising residues 1 to 525 of FIG. 120 (SEQ ID NO:301). Additional embodiments of the present invention are directed to PRO1071 polypeptides comprising amino acids about 26 to 525 of FIG. 120 (SEQ ID NO:301). Optionally, the PRO1071 polypeptide is obtained or is obtainable by expressing the polypeptide encoded by the cDNA insert of the DNA58847-1383 vector deposited on May 20, 1998 as ATCC 209879.

46. PRO1072

Applicants have identified a cDNA clone that encodes a novel polypeptide having homology to reductase proteins, wherein the polypeptide is designated in the present application as "PRO1072".

In one embodiment, the invention provides an isolated nucleic acid molecule comprising DNA encoding a PRO1072 polypeptide. In one aspect, the isolated nucleic acid comprises DNA encoding the PRO1072 polypeptide having amino acid residues 1 to 336 of FIG. 122 (SEQ ID NO:303), or is complementary to such encoding nucleic acid sequence, and remains stably bound to it under at least moderate, and optionally, under high stringency conditions. In other aspects, the isolated nucleic acid comprises DNA encoding the PRO1072 polypeptide having amino acid residues about 22 to 336 of FIG. 122 (SEQ ID NO:303), or is complementary to such encoding nucleic acid sequence, and remains stably bound to it under at least moderate, and optionally, under high stringency conditions. The isolated nucleic acid sequence may comprise the cDNA insert of the DNA58747-1384 vector deposited on May 14, 1998 as ATCC 209868 which includes the nucleotide sequence encoding PRO1072.

In another embodiment, the invention provides isolated PRO1072 polypeptide. In particular, the invention provides isolated native sequence PRO1072 polypeptide, which in one embodiment, includes an amino acid sequence comprising residues 1 to 336 of FIG. 122 (SEQ ID NO:303). Additional embodiments of the present invention are directed to PRO1072 polypeptides comprising amino acids about 22 to 336 of FIG. 122 (SEQ ID NO:303). Optionally, the PRO1072 polypeptide is obtained or is obtainable by expressing the polypeptide encoded by the cDNA insert of the DNA58747-1384 vector deposited on May 14, 1998 as ATCC 209868.

In another embodiment, the invention provides an expressed sequence tag (EST) designated herein as DNA40210 comprising the nucleotide sequence of FIG. 123 (SEQ ID NO:304).

47. PRO1075

Applicants have identified a cDNA clone that encodes a novel polypeptide having homology to protein disulfide isomerase, wherein the polypeptide is designated in the present application as "PRO1075".

In one embodiment, the invention provides an isolated nucleic acid molecule comprising DNA encoding a PRO1075 polypeptide. In one aspect, the isolated nucleic acid comprises DNA encoding the PRO1075 polypeptide having amino acid residues 1 to 406 of FIG. 125 (SEQ ID NO:309), or is complementary to such encoding nucleic acid sequence, and remains stably bound to it under at least moderate, and optionally, under high stringency conditions. In other aspects, the isolated nucleic acid comprises DNA encoding the PRO1075 polypeptide having amino acid residues about 30 to 406 of FIG. 125 (SEQ ID NO:309), or is complementary to such encoding nucleic acid sequence, and remains stably bound to it under at least moderate, and optionally, under high stringency conditions. The isolated nucleic acid sequence may comprise the cDNA insert of the DNA57689-1385 vector deposited on May 14, 1998 as ATCC 209869 which includes the nucleotide sequence encoding PRO1075.

In another embodiment, the invention provides isolated PRO1075 polypeptide. In particular, the invention provides isolated native sequence PRO1075 polypeptide, which in one embodiment, includes an amino acid sequence comprising residues 1 to 406 of FIG. 125 (SEQ ID NO:309). Additional embodiments of the present invention are directed to PRO1075 polypeptides comprising amino acids about 30 to 406 of FIG. 125 (SEQ ID NO:309). Optionally, the PRO1075 polypeptide is obtained or is obtainable by expressing the polypeptide encoded by the cDNA insert of the DNA57689-1385 vector deposited on May 14, 1998 as ATCC 209869.

In another embodiment, the invention provides an expressed sequence tag (EST) designated herein as DNA13059 comprising the nucleotide sequence of FIG. 126 (SEQ ID NO:310).

In another embodiment, the invention provides an expressed sequence tag (EST) designated herein as DNA19463 comprising the nucleotide sequence of FIG. 127 (SEQ ID NO:311).

48. PRO181

Applicants have identified a cDNA clone that encodes a novel polypeptide having homology to the cornichon protein, wherein the polypeptide is designated in the present application as "PRO181".

In one embodiment, the invention provides an isolated nucleic acid molecule comprising DNA encoding a PRO181 polypeptide. In one aspect, the isolated nucleic acid comprises DNA encoding the PRO181 polypeptide having amino acid residues 1 to 144 of FIG. 129 (SEQ ID NO:322), or is complementary to such encoding nucleic acid sequence, and remains stably bound to it under at least moderate, and optionally, under high stringency conditions. In other aspects, the isolated nucleic acid comprises DNA encoding the PRO181 polypeptide having amino acid residues about 21 to 144 of FIG. 129 (SEQ ID NO:322) or amino acid 1 or about 21 to X of FIG. 129 (SEQ ID NO:322) where X is any amino acid from 52 to 61 of FIG. 129 (SEQ ID NO:322), or is complementary to such encoding nucleic acid sequence, and remains stably bound to it under at least moderate, and optionally, under high stringency conditions. The isolated nucleic acid sequence may comprise the cDNA insert of the DNA23330-1390 vector deposited on Apr. 14, 1998 as ATCC 209775 which includes the nucleotide sequence encoding PRO181.

In another embodiment, the invention provides isolated PRO181 polypeptide. In particular, the invention provides isolated native sequence PRO181 polypeptide, which in one embodiment, includes an amino acid sequence comprising residues 1 to 144 of FIG. 129 (SEQ ID NO:322). Additional embodiments of the present invention are directed to PRO181 polypeptides comprising amino acids about 21 to 144 of FIG. 129 (SEQ ID NO:322) or amino acid 1 or about 21 to X of FIG. 129 (SEQ ID NO:322), where X is any amino acid from 52 to 61 of FIG. 129 (SEQ ID NO:322). Optionally, the PRO181 polypeptide is obtained or is obtainable by expressing the polypeptide encoded by the cDNA insert of the DNA23330-1390 vector deposited on Apr. 14, 1998 as ATCC 209775.

In another embodiment, the invention provides an expressed sequence tag (EST) designated herein as DNA13242 comprising the nucleotide sequence of FIG. 130 (SEQ ID NO:323).

49. PRO195

Applicants have identified a cDNA clone that encodes a novel transmembrane polypeptide, wherein the polypeptide is designated in the present application as "PRO195".

In one embodiment, the invention provides an isolated nucleic acid molecule comprising DNA encoding a PRO195 polypeptide. In one aspect, the isolated nucleic acid comprises DNA encoding the PRO195 polypeptide having amino acid residues 1 to 323 of FIG. 132 (SEQ ID NO:330), or is complementary to such encoding nucleic acid sequence, and remains stably bound to it under at least moderate, and optionally, under high stringency conditions. In other aspects, the isolated nucleic acid comprises DNA encoding the PRO195 polypeptide having amino acid residues about 32 to 323 of FIG. 132 (SEQ ID NO:330) or amino acid 1 or about 32 to X of FIG. 132 (SEQ ID NO:330) where X is any amino acid from 236 to 245 of FIG. 132 (SEQ ID NO:330), or is complementary to such encoding nucleic acid sequence, and remains stably bound to it under at least moderate, and optionally, under high stringency conditions. The isolated nucleic acid sequence may comprise the cDNA insert of the DNA26847-1395 vector deposited on Apr. 14, 1998 as ATCC 209772 which includes the nucleotide sequence encoding PRO195.

In another embodiment, the invention provides isolated PRO195 polypeptide. In particular, the invention provides isolated native sequence PRO195 polypeptide, which in one embodiment, includes an amino acid sequence comprising residues 1 to 323 of FIG. 132 (SEQ ID NO:330). Additional embodiments of the present invention are directed to PRO195 polypeptides comprising amino acids about 32 to 323 of FIG. 132 (SEQ ID NO:330) or amino acid 1 or about 32 to X of FIG. 132 (SEQ ID NO:330), where X is any amino acid from 236 to 245 of FIG. 132 (SEQ ID NO:330). Optionally, the PRO195 polypeptide is obtained or is obtainable by expressing the polypeptide encoded by the cDNA insert of the DNA26847-1395 vector deposited on Apr. 14, 1998 as ATCC 209772.

In another embodiment, the invention provides an expressed sequence tag (EST) comprising the nucleotide sequence of FIG. 133 (SEQ ID NO:331), herein designated DNA15062.

In another embodiment, the invention provides an expressed sequence tag (EST) comprising the nucleotide sequence of FIG. 134 (SEQ ID NO:332), herein designated DNA13199.

50. PRO865

Applicants have identified a cDNA clone that encodes a novel secreted polypeptide, wherein the polypeptide is designated in the present application as "PRO865".

In one embodiment, the invention provides an isolated nucleic acid molecule comprising DNA encoding a PRO865 polypeptide. In one aspect, the isolated nucleic acid comprises DNA encoding the PRO865 polypeptide having amino acid residues 1 to 468 of FIG. 136 (SEQ ID NO:337), or is complementary to such encoding nucleic acid sequence, and remains stably bound to it under at least moderate, and optionally, under high stringency conditions. In other aspects, the isolated nucleic acid comprises DNA encoding the PRO865 polypeptide having amino acid residues about 24 to 229 of FIG. 136 (SEQ ID NO:337), or is complementary to such encoding nucleic acid sequence, and remains stably bound to it under at least moderate, and optionally, under high stringency conditions. The isolated nucleic acid sequence may comprise the cDNA insert of the DNA53974-1401 vector deposited on Apr. 14, 1998 as ATCC 209774 which includes the nucleotide sequence encoding PRO865.

In another embodiment, the invention provides isolated PRO865 polypeptide. In particular, the invention provides isolated native sequence PRO865 polypeptide, which in one embodiment, includes an amino acid sequence comprising residues 1 to 468 of FIG. 136 (SEQ ID NO:337). An additional embodiment of the present invention is directed to a PRO865 polypeptide comprising amino acids about 24 to 468 of FIG. 136 (SEQ ID NO:337). Optionally, the PRO865 polypeptide is obtained or is obtainable by expressing the polypeptide encoded by the cDNA insert of the DNA53974-1401 vector deposited on Apr. 14, 1998 as ATCC 209774.

In another embodiment, the invention provides an expressed sequence tag (EST) comprising the nucleotide sequence of FIG. 137 (SEQ ID NO:338), herein designated as DNA37642.

51. PRO827

Applicants have identified a cDNA clone that encodes a novel polypeptide having homology to integrin proteins, wherein the polypeptide is designated in the present application as "PRO827".

In one embodiment, the invention provides an isolated nucleic acid molecule comprising DNA encoding a PRO827 polypeptide. In one aspect, the isolated nucleic acid comprises DNA encoding the PRO827 polypeptide having amino acid residues 1 to 124 of FIG. 139 (SEQ ID NO:346), or is complementary to such encoding nucleic acid sequence, and remains stably bound to it under at least moderate, and optionally, under high stringency conditions. In other aspects, the isolated nucleic acid comprises DNA encoding the PRO827 polypeptide having amino acid residues about 23 to 124 of FIG. 139 (SEQ ID NO:346), or is complementary to such encoding nucleic acid sequence, and remains stably bound to it under at least moderate, and optionally, under high stringency conditions. The isolated nucleic acid sequence may comprise the cDNA insert of the DNA57039-1402 vector deposited on Apr. 14, 1998 as ATCC 209777 which includes the nucleotide sequence encoding PRO827.

In another embodiment, the invention provides isolated PRO827 polypeptide. In particular, the invention provides isolated native sequence PRO827 polypeptide, which in one embodiment, includes an amino acid sequence comprising residues 1 to 124 of FIG. 139 (SEQ ID NO:346). An additional embodiment of the present invention is directed to a PRO827 polypeptide comprising amino acids about 23 to 124 of FIG. 139 (SEQ ID NO:346). Optionally, the PRO827 polypeptide is obtained or is obtainable by expressing the polypeptide encoded by the cDNA insert of the DNA57039-1402 vector deposited on Apr. 14, 1998 as ATCC 209777.

52. PRO1114

Applicants have identified a cDNA clone that encodes a novel polypeptide having homology to cytokine receptor family-4 proteins, wherein the polypeptide is designated in the present application as "PRO1114".

In one embodiment, the invention provides an isolated nucleic acid molecule comprising DNA encoding a PRO1114 polypeptide. In one aspect, the isolated nucleic acid comprises DNA encoding the PRO1114 polypeptide having amino acid residues 1 to 311 of FIG. 142 (SEQ ID NO:352), or is complementary to such encoding nucleic acid sequence, and remains stably bound to it under at least moderate, and optionally, under high stringency conditions. In other aspects, the isolated nucleic acid comprises DNA encoding the PRO1114 polypeptide having amino acid residues about 30 to 311 of FIG. 142 (SEQ ID NO:352) or amino acid 1 or about 30 to X of FIG. 142 (SEQ ID NO:352), where X is any amino acid from 225 to 234 of FIG. 142 (SEQ ID NO:352), or is complementary to such encoding nucleic acid sequence, and remains stably bound to it under at least moderate, and optionally, under high stringency conditions. The isolated nucleic acid sequence may comprise the cDNA insert of the DNA57033-1403 vector deposited on May 27, 1998 as ATCC 209905 which includes the nucleotide sequence encoding PRO1114.

In another embodiment, the invention provides isolated PRO1114 polypeptide. In particular, the invention provides isolated native sequence PRO1114 polypeptide, which in one embodiment, includes an amino acid sequence comprising residues 1 to 311 of FIG. 142 (SEQ ID NO:352). Additional embodiments of the present invention are directed to PRO1114 polypeptides comprising amino acids about 30 to 311 of FIG. 142 (SEQ ID NO:352) or amino acid 1 or about 30 to X of FIG. 142 (SEQ ID NO:352), where X is any amino acid from 225 to 234 of FIG. 142 (SEQ ID NO:352). Optionally, the PRO1114 polypeptide is obtained or is obtainable by expressing the polypeptide encoded by the cDNA insert of the DNA57033-1403 vector deposited on May 27, 1998 as ATCC 209905.

In another embodiment, the invention provides an expressed sequence tag (EST) designated herein as DNA48466 comprising the nucleotide sequence of FIG. 143 (SEQ ID NO:353).

A cDNA clone (DNA57033-1403) has been identified that encodes a novel interferon receptor polypeptide, designated in the present application as "PRO1114 interferon receptor".

In one embodiment, the invention provides an isolated nucleic acid molecule comprising DNA encoding a PRO1114 interferon receptor polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1114 interferon receptor polypeptide having the sequence of amino acid residues from about 1 or about 30 to about 311, inclusive of FIG. 142 (SEQ ID NO:352), or (b) the complement of the DNA molecule of (a).

In another aspect, the invention concerns an isolated nucleic acid molecule encoding a PRO1114 interferon receptor polypeptide comprising DNA hybridizing to the complement of the nucleic acid between about nucleotides 250 or about 337 and about 1182, inclusive, of FIG. 141 (SEQ ID NO:351). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209905 (DNA57033-1403) or (b) the complement of the nucleic acid molecule of (a). In a preferred embodiment, the nucleic acid comprises a DNA encoding the same mature polypeptide encoded by the human protein cDNA in ATCC Deposit No. 209905 (DNA57033-1403).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 30 to about 311, inclusive of FIG. 142 (SEQ ID NO:352), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1114 interferon receptor polypeptide having the sequence of amino acid residues from 1 or about 30 to about 311, inclusive of FIG. 142 (SEQ ID NO:352), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1114 interferon receptor polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 29 in the sequence of FIG. 142 (SEQ ID NO:352). The transmembrane domain has been tentatively identified as extending from about amino acid position 230 to about amino acid position 255 in the PRO1114 interferon receptor amino acid sequence (FIG. 142, SEQ ID NO:352).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 30 to about 311, inclusive of FIG. 142 (SEQ ID NO:352), or (b) the complement of the DNA of (a).

Another embodiment is directed to fragments of a PRO1114 interferon receptor polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 141 (SEQ ID NO:351).

In another embodiment, the invention provides a vector comprising DNA encoding PRO1114 interferon receptor or its variants. The vector may comprise any of the isolated nucleic acid molecules hereinabove identified.

A host cell comprising such a vector is also provided. By way of example, the host cells may be CHO cells, *E. coli*, or yeast. A process for producing PRO1114 interferon receptor polypeptides is further provided and comprises culturing host cells under conditions suitable for expression of PRO1114 interferon receptor and recovering PRO1114 interferon receptor from the cell culture.

In another embodiment, the invention provides isolated PRO1114 interferon receptor polypeptide encoded by any of the isolated nucleic acid sequences hereinabove identified.

In a specific aspect, the invention provides isolated native sequence PRO1114 interferon receptor polypeptide, which in certain embodiments, includes an amino acid sequence comprising residues 1 or about 30 to about 311 of FIG. 142 (SEQ ID NO:352).

In another aspect, the invention concerns an isolated PRO1114 interferon receptor polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 30 to about 311, inclusive of FIG. 142 (SEQ ID NO:352).

In a further aspect, the invention concerns an isolated PRO1114 interferon receptor polypeptide, comprising an amino acid sequence scoring at least about 80% positives, preferably at least about 85% positives, more preferably at least about 90% positives, most preferably at least about 95% positives when compared with the amino acid sequence of residues 1 or about 30 to about 311, inclusive of FIG. 142 (SEQ ID NO:352).

In yet another aspect, the invention concerns an isolated PRO1114 interferon receptor polypeptide, comprising the sequence of amino acid residues 1 or about 30 to about 311, inclusive of FIG. 142 (SEQ ID NO:352), or a fragment thereof sufficient to provide a binding site for an anti-PRO1114 interferon receptor antibody. Preferably, the PRO1114 interferon receptor fragment retains a qualitative biological activity of a native PRO1114 interferon receptor polypeptide.

In a still further aspect, the invention provides a polypeptide produced by (i) hybridizing a test DNA molecule under stringent conditions with (a) a DNA molecule encoding a PRO1114 interferon receptor polypeptide having the sequence of amino acid residues from about 1 or about 30 to about 311, inclusive of FIG. 142 (SEQ ID NO:352), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In another embodiment, the invention provides chimeric molecules comprising a PRO1114 interferon receptor polypeptide fused to a heterologous polypeptide or amino acid sequence. An example of such a chimeric molecule comprises a PRO1114 interferon receptor polypeptide fused to an epitope tag sequence or a Fc region of an immunoglobulin.

In another embodiment, the invention provides an antibody which specifically binds to a PRO1114 interferon receptor polypeptide. Optionally, the antibody is a monoclonal antibody.

In yet another embodiment, the invention concerns agonists and antagonists of a native PRO1114 interferon receptor polypeptide. In a particular embodiment, the agonist or antagonist is an anti-PRO1114 interferon receptor antibody.

In a further embodiment, the invention concerns a method of identifying agonists or antagonists of a native PRO1114 interferon receptor polypeptide by contacting the native PRO1114 interferon receptor polypeptide with a candidate molecule and monitoring a biological activity mediated by said polypeptide.

In a still further embodiment, the invention concerns a composition comprising a PRO1114 interferon receptor polypeptide, or an agonist or antagonist as hereinabove defined, in combination with a pharmaceutically acceptable carrier.

53. PRO237

Applicants have identified a cDNA clone that encodes a novel polypeptide having homology to carbonic anhydrase, wherein the polypeptide is designated in the present application as "PRO237".

In one embodiment, the invention provides an isolated nucleic acid molecule comprising DNA encoding a PRO237 polypeptide. In one aspect, the isolated nucleic acid comprises DNA encoding the PRO237 polypeptide having amino acid residues 1 to 328 of FIG. 145 (SEQ ID NO:358), or is complementary to such encoding nucleic acid sequence, and remains stably bound to it under at least moderate, and optionally, under high stringency conditions. In other aspects, the isolated nucleic acid comprises DNA encoding the PRO237 polypeptide having amino acid residues about 24 to 328 of FIG. 145 (SEQ ID NO:358) or amino acid 1 or about 24 to X of FIG. 145 (SEQ ID NO:358), where X is any amino acid from 172 to 181 of FIG. 145 (SEQ ID NO:358), or is complementary to such encoding nucleic acid sequence, and remains stably bound to it under at least moderate, and optionally, under high stringency conditions. The isolated nucleic acid sequence may comprise the cDNA insert of the DNA34353-1428 vector deposited on May 12, 1998 as ATCC 209855 which includes the nucleotide sequence encoding PRO237.

In another embodiment, the invention provides isolated PRO237 polypeptide. In particular, the invention provides isolated native sequence PRO237 polypeptide, which in one embodiment, includes an amino acid sequence comprising residues 1 to 328 of FIG. 145 (SEQ ID NO:358). Additional embodiments of the present invention are directed to PRO237 polypeptides comprising amino acids about 24 to 328 of FIG. 145 (SEQ ID NO:358) or amino acid 1 or about 24 to X of FIG. 145 (SEQ ID NO:358), where X is any amino acid from 172 to 181 of FIG. 145 (SEQ ID NO:358). Optionally, the PRO237 polypeptide is obtained or is obtainable by expressing the polypeptide encoded by the cDNA insert of the DNA34353-1428 vector deposited on May 12, 1998 as ATCC 209855.

54. PRO541

Applicants have identified a cDNA clone that encodes a novel polypeptide having homology to a trypsin inhibitor protein, wherein the polypeptide is designated in the present application as "PRO541".

In one embodiment, the invention provides an isolated nucleic acid molecule comprising DNA encoding a PRO541 polypeptide. In one aspect, the isolated nucleic acid comprises DNA encoding the PRO541 polypeptide having amino acid residues 1 to 500 of FIG. 147 (SEQ ID NO:363), or is complementary to such encoding nucleic acid sequence, and remains stably bound to it under at least moderate, and optionally, under high stringency conditions. In other aspects, the isolated nucleic acid comprises DNA encoding the PRO541 polypeptide having amino acid residues about 21 to 500 of FIG. 147 (SEQ ID NO:363), or is complementary to such encoding nucleic acid sequence, and remains stably bound to it under at least moderate, and optionally, under high stringency conditions. The isolated nucleic acid sequence may comprise the cDNA insert of the DNA45417-1432 vector deposited on May 27, 1998 as ATCC 209910 which includes the nucleotide sequence encoding PRO541.

In another embodiment, the invention provides isolated PRO541 polypeptide. In particular, the invention provides isolated native sequence PRO541 polypeptide, which in one embodiment, includes an amino acid sequence comprising residues 1 to 500 of FIG. 147 (SEQ ID NO:363). Additional embodiments of the present invention are directed to PRO541 polypeptides comprising amino acids about 21 to 500 of FIG. 147 (SEQ ID NO:363). Optionally, the PRO541 polypeptide is obtained or is obtainable by expressing the polypeptide encoded by the cDNA insert of the DNA45417-1432 vector deposited on May 27, 1998 as ATCC 209910.

55. PRO273

Applicants have identified a cDNA clone that encodes a novel polypeptide, wherein the polypeptide is designated in the present application as "PRO273".

In one embodiment, the invention provides an isolated nucleic acid molecule comprising DNA encoding a PRO273 polypeptide. In one aspect, the isolated nucleic acid comprises DNA encoding the PRO273 polypeptide having amino acid residues 1 through 111 of FIG. 149 (SEQ ID NO:370), or is complementary to such encoding nucleic acid sequence, and remains stably bound to it under at least moderate, and optionally, under high stringency conditions.

In another embodiment, the invention provides isolated PRO273 polypeptide. In particular, the invention provides isolated native sequence PRO273 polypeptide, which in one embodiment, includes an amino acid sequence comprising residues 1 through 111 of FIG. 149 (SEQ ID NO:370).

56. PRO701

Applicants have identified a cDNA clone that encodes a novel polypeptide having homology to neuroligins 1, 2, and 3, wherein the polypeptide is designated in the present application as "PRO701".

In one embodiment, the invention provides an isolated nucleic acid molecule comprising DNA encoding a PRO701 polypeptide. In one aspect, the isolated nucleic acid comprises DNA encoding the PRO701 polypeptide having amino acid residues 1 through 816 of FIG. 151 (SEQ ID NO:375), or is complementary to such encoding nucleic acid sequence, and remains stably bound to it under at least moderate, and optionally, under high stringency conditions. The isolated nucleic acid sequence may comprise the cDNA insert of the vector deposited with the ATCC on Mar. 31, 1998 which includes the nucleotide sequence encoding PRO701.

In another embodiment, the invention provides isolated PRO701 polypeptide. In particular, the invention provides isolated native sequence PRO701 polypeptide, which in one embodiment, includes an amino acid sequence comprising residues 1 through 816 of FIG. 151 (SEQ ID NO:375). An additional embodiment of the present invention is directed to an isolated extracellular domain of a PRO701 polypeptide. Optionally, the PRO701 polypeptide is obtained or is obtainable by expressing the polypeptide encoded by the cDNA insert of the vector deposited with the ATCC on Mar. 31, 1998.

57. PRO704

Applicants have identified a cDNA clone that encodes a novel polypeptide having sequence identity with VIP36, wherein the polypeptide is designated in the present application as "PRO704".

In one embodiment, the invention provides an isolated nucleic acid molecule comprising DNA encoding a PRO704 polypeptide. In one aspect, the isolated nucleic acid comprises DNA encoding the PRO704 polypeptide having amino acid residues 1 through 348 of FIG. 153 (SEQ ID NO:380), or is complementary to such encoding nucleic acid sequence, and remains stably bound to it under at least moderate, and optionally, under high stringency conditions. The isolated nucleic acid sequence may comprise the cDNA insert of the vector deposited on Mar. 31, 1998 with the ATCC as DNA50911-1288, which includes the nucleotide sequence encoding PRO704.

In another embodiment, the invention provides isolated PRO704 polypeptide. In particular, the invention provides isolated native sequence PRO704 polypeptide, which in one embodiment, includes an amino acid sequence comprising residues 1 through 348 of FIG. 153 (SEQ ID NO:380). An additional embodiment of the present invention is directed to an isolated extracellular domain of a PRO704 polypeptide. Optionally, the PRO704 polypeptide is obtained or is obtain-

58. PRO706

Applicants have identified a cDNA clone that encodes a novel polypeptide having homology to prostatic acid phosphatase precursor and lysosomal acid phosphatase precursor, wherein the polypeptide is designated in the present application as "PRO706".

In one embodiment, the invention provides an isolated nucleic acid molecule comprising DNA encoding a PRO706 polypeptide. In one aspect, the isolated nucleic acid comprises DNA encoding the PRO706 polypeptide having amino acid residues 1 through 480 of FIG. 155 (SEQ ID NO:385), or is complementary to such encoding nucleic acid sequence, and remains stably bound to it under at least moderate, and optionally, under high stringency conditions. The isolated nucleic acid sequence may comprise the cDNA insert of the vector deposited on Apr. 21, 1998 with the ATCC as DNA48329-1290 which includes the nucleotide sequence encoding PRO706.

In another embodiment, the invention provides isolated PRO706 polypeptide. In particular, the invention provides isolated native sequence PRO706 polypeptide, which in one embodiment, includes an amino acid sequence comprising residues 1 through 480 of FIG. 155 (SEQ ID NO:385), or comprising residues 19 through 480 of FIG. 155 (SEQ ID NO:385). Optionally, the PRO706 polypeptide is obtained or is obtainable by expressing the polypeptide encoded by the cDNA insert of the vector deposited on Apr. 21, 1998 with the ATCC as DNA48329-1290.

59. PRO707

Applicants have identified a cDNA clone that encodes a novel polypeptide having homology to cadherins, particularly cadherin FIB3, wherein the polypeptide is designated in the present application as "PRO707".

In one embodiment, the invention provides an isolated nucleic acid molecule comprising DNA encoding a PRO707 polypeptide. In one aspect, the isolated nucleic acid comprises DNA encoding the PRO707 polypeptide having amino acid residues 1 to 916 of FIG. 157 (SEQ ID NO:390), or is complementary to such encoding nucleic acid sequence, and remains stably bound to it under at least moderate, and optionally, under high stringency conditions. The isolated nucleic acid sequence may comprise the cDNA insert of the vector deposited on May 27, 1998 with the ATCC as DNA48306-1291 which includes the nucleotide sequence encoding PRO707.

In another embodiment, the invention provides isolated PRO707 polypeptide. In particular, the invention provides isolated native sequence PRO707 polypeptide, which in one embodiment, includes an amino acid sequence comprising residues 1 to 916 of FIG. 157 (SEQ ID NO:390). An additional embodiment of the present invention is directed to an isolated extracellular domain of a PRO707 polypeptide. Optionally, the PRO707 polypeptide is obtained or is obtainable by expressing the polypeptide encoded by the cDNA insert of the vector deposited on May 27, 1998 with the ATCC as DNA48306-1291.

60. PRO322

Applicants have identified a cDNA clone that encodes a novel polypeptide having homology to neuropsin, wherein the polypeptide is designated in the present application as "PRO322".

In one embodiment, the invention provides an isolated nucleic acid molecule comprising DNA encoding a PRO322 polypeptide. In one aspect, the isolated nucleic acid comprises DNA encoding the PRO322 polypeptide having amino acid residues 1 or 24 through 260 of FIG. 159 (SEQ ID NO:395), or is complementary to such encoding nucleic acid sequence, and remains stably bound to it under at least moderate, and optionally, under high stringency conditions. The isolated nucleic acid sequence may comprise the cDNA insert of the vector deposited on Mar. 11, 1998 as ATCC no. 209669 which includes the nucleotide sequence encoding PRO322.

In another embodiment, the invention provides isolated PRO322 polypeptide. In particular, the invention provides isolated native sequence PRO322 polypeptide, which in one embodiment, includes an amino acid sequence comprising residues 1 or 24 through 260 of FIG. 159 (SEQ ID NO:395). An additional embodiment of the present invention is directed to an isolated extracellular domain of a PRO322 polypeptide. Optionally, the PRO322 polypeptide is obtained or is obtainable by expressing the polypeptide encoded by the cDNA insert of the vector deposited on Mar. 11, 1998 as ATCC no. 209669.

61. PRO526

Applicants have identified a cDNA clone that encodes a novel polypeptide having sequence identity with ALS, wherein the polypeptide is designated in the present application as "PRO526".

In one embodiment, the invention provides an isolated nucleic acid molecule comprising DNA encoding a PRO526 polypeptide. In one aspect, the isolated nucleic acid comprises DNA encoding the PRO526 polypeptide having amino acid residues 1 to 473 of FIG. 161 (SEQ ID NO:400), or is complementary to such encoding nucleic acid sequence, and remains stably bound to it under at least moderate, and optionally, under high stringency conditions. The isolated nucleic acid sequence may comprise the cDNA insert of the vector deposited on Mar. 26, 1998 with the ATCC as DNA44184-1319 which includes the nucleotide sequence encoding PRO526.

In another embodiment, the invention provides isolated PRO526 polypeptide. In particular, the invention provides isolated native sequence PRO526 polypeptide, which in one embodiment, includes an amino acid sequence comprising residues 1 to 473 of FIG. 161 (SEQ ID NO:400). Optionally, the PRO526 polypeptide is obtained or is obtainable by expressing the polypeptide encoded by the cDNA insert of the vector deposited on Mar. 26, 1998 with the ATCC as DNA44184-1319 which includes the nucleotide sequence encoding PRO526.

62. PRO531

Applicants have identified a cDNA clone that encodes a novel polypeptide having sequence identity with protocadherins, wherein the polypeptide is designated in the present application as "PRO531".

In one embodiment, the invention provides an isolated nucleic acid molecule comprising DNA encoding a PRO531 polypeptide. In one aspect, the isolated nucleic acid comprises DNA encoding the PRO531 polypeptide having amino acid residues 1 to 789 of FIG. 163 (SEQ ID NO:405), or is complementary to such encoding nucleic acid sequence, and remains stably bound to it under at least moderate, and optionally, under high stringency conditions. The isolated nucleic acid sequence may comprise the cDNA insert of the vector deposited on Mar. 26, 1998 as DNA48314-1320 which includes the nucleotide sequence encoding PRO531.

In another embodiment, the invention provides isolated PRO531 polypeptide. In particular, the invention provides isolated native sequence PRO531 polypeptide, which in one embodiment, includes an amino acid sequence comprising residues 1 to 789 of FIG. 163 (SEQ ID NO:405). An additional embodiment of the present invention is directed to an isolated extracellular domain of a PRO531 polypeptide. Optionally, the PRO531 polypeptide is obtained or is obtainable by expressing the polypeptide encoded by the cDNA insert of the vector deposited on Mar. 26, 1998 as DNA48314-1320.

63. PRO534

Applicants have identified a cDNA clone that encodes a novel polypeptide having sequence identity with disulfide isomerase (sometimes referred to herein as protein disulfide isomerase), wherein the polypeptide is designated in the present application as "PRO534".

In one embodiment, the invention provides an isolated nucleic acid molecule comprising DNA encoding a PRO534 polypeptide. In one aspect, the isolated nucleic acid comprises DNA encoding the PRO534 polypeptide having amino acid residues 1 to 360 of FIG. 165 (SEQ ID NO:410), or is complementary to such encoding nucleic acid sequence, and remains stably bound to it under at least moderate, and optionally, under high stringency conditions. The isolated nucleic acid sequence may comprise the cDNA insert of the vector deposited on Mar. 26, 1998 as DNA48333-1321 which includes the nucleotide sequence encoding PRO534.

In another embodiment, the invention provides isolated PRO534 polypeptide. In particular, the invention provides isolated native sequence PRO534 polypeptide, which in one embodiment, includes an amino acid sequence comprising residues 1 to 360 of FIG. 165 (SEQ ID NO:410). An additional embodiment of the present invention is directed to an isolated extracellular domain of a PRO534 polypeptide. Optionally, the PRO534 polypeptide is obtained or is obtainable by expressing the polypeptide encoded by the cDNA insert of the vector deposited on Mar. 26, 1998 as DNA48333-1321.

64. PRO697

Applicants have identified a cDNA clone that encodes a novel polypeptide having sequence identity with sFRPs, wherein the polypeptide is designated in the present application as "PRO697".

In one embodiment, the invention provides an isolated nucleic acid molecule comprising DNA encoding a PRO697 polypeptide. In one aspect, the isolated nucleic acid comprises DNA encoding the PRO697 polypeptide having amino acid residues 1 through 295 of FIG. 167 (SEQ ID NO:415), or is complementary to such encoding nucleic acid sequence, and remains stably bound to it under at least moderate, and optionally, under high stringency conditions. The isolated nucleic acid sequence may comprise the cDNA insert of the vector deposited with the ATCC on Mar. 26, 1998 as DNA50920-1325 which includes the nucleotide sequence encoding PRO697.

In another embodiment, the invention provides isolated PRO697 polypeptide. In particular, the invention provides isolated native sequence PRO697 polypeptide, which in one embodiment, includes an amino acid sequence comprising residues 1 through 295 of FIG. 167 (SEQ ID NO:415). Optionally, the PRO697 polypeptide is obtained or is obtainable by expressing the polypeptide encoded by the cDNA insert of the vector deposited with the ATCC on Mar. 26, 1998 as DNA50920-1325.

65. PRO717

Applicants have identified a cDNA clone that encodes a novel 12 transmembrane polypeptide, wherein the polypeptide is designated in the present application as "PRO717".

In one embodiment, the invention provides an isolated nucleic acid molecule comprising DNA encoding a PRO717 polypeptide. In one aspect, the isolated nucleic acid comprises DNA encoding the PRO717 polypeptide having amino acid residues 1 through 560 of FIG. 169 (SEQ ID NO:420), or is complementary to such encoding nucleic acid sequence, and remains stably bound to it under at least moderate, and optionally, under high stringency conditions. The isolated nucleic acid sequence may comprise the cDNA insert of the vector deposited on Apr. 28, 1998 with the ATCC as DNA50988-1326 which includes the nucleotide sequence encoding PRO717.

In another embodiment, the invention provides isolated PRO717 polypeptide. In particular, the invention provides isolated native sequence PRO717 polypeptide, which in one embodiment, includes an amino acid sequence comprising residues 1 through 560 of FIG. 169 (SEQ ID NO:420). An additional embodiment of the present invention is directed to an isolated extracellular domain of a PRO717 polypeptide. Optionally, the PRO717 polypeptide is obtained or is obtainable by expressing the polypeptide encoded by the cDNA insert of the vector deposited on Apr. 28, 1998 with the ATCC as DNA50988-1326.

66. PRO731

Applicants have identified a cDNA clone that encodes a novel polypeptide having sequence identity with protocadherin 4, wherein the polypeptide is designated in the present application as "PRO731".

In one embodiment, the invention provides an isolated nucleic acid molecule comprising DNA encoding a PRO731 polypeptide. In one aspect, the isolated nucleic acid comprises DNA encoding the PRO731 polypeptide having amino acid residues 1 through 1184 of FIG. 171 (SEQ ID NO:425), or is complementary to such encoding nucleic acid sequence, and remains stably bound to it under at least moderate, and optionally, under high stringency conditions. The isolated nucleic acid sequence may comprise the cDNA insert of the vector deposited on Mar. 31, 1998 with the ATCC as DNA48331-1329 which includes the nucleotide sequence encoding PRO731.

In another embodiment, the invention provides isolated PRO731 polypeptide. In particular, the invention provides isolated native sequence PRO731 polypeptide, which in one embodiment, includes an amino acid sequence comprising residues 1 through 1184 of FIG. 171 (SEQ ID NO:425). An additional embodiment of the present invention is directed to an isolated extracellular domain of a PRO731 polypeptide. Optionally, the PRO731 polypeptide is obtained or is obtainable by expressing the polypeptide encoded by the cDNA insert of the vector deposited on Mar. 31, 1998 with the ATCC as DNA48331-1329.

67. PRO218

Applicants have identified a cDNA clone that encodes a novel multi-transmembrane protein having sequence identity with membrane regulator proteins, wherein the polypeptide is designated in the present application as "PRO218".

In one embodiment, the invention provides an isolated nucleic acid molecule comprising DNA encoding a PRO218 polypeptide. In one aspect, the isolated nucleic acid comprises DNA encoding the PRO218 polypeptide having amino acid residues 1 through 455 of FIG. 173 (SEQ ID NO:430), or is complementary to such encoding nucleic acid sequence, and remains stably bound to it under at least moderate, and optionally, under high stringency conditions. The isolated nucleic acid sequence may comprise the cDNA insert of the vector deposited on Apr. 28, 1998 with the ATCC as DNA30867-1335 which includes the nucleotide sequence encoding PRO218.

In another embodiment, the invention provides isolated PRO218 polypeptide. In particular, the invention provides isolated native sequence PRO218 polypeptide, which in one embodiment, includes an amino acid sequence comprising residues 1 through 455 of FIG. 173 (SEQ ID NO:430). Optionally, the PRO218 polypeptide is obtained or is obtainable by expressing the polypeptide encoded by the cDNA insert of the vector deposited on Apr. 28, 1998 with the ATCC as DNA30867-1335.

In another embodiment, the invention provides an expressed sequence tag (EST) sequence comprising the nucleotide sequence of FIG. 174 (SEQ ID NO:431), designated herein as DNA14472.

In another embodiment, the invention provides an expressed sequence tag (EST) sequence comprising the nucleotide sequence of FIG. 175 (SEQ ID NO:432), designated herein as DNA15846.

68. PRO768

Applicants have identified a cDNA clone that encodes a novel polypeptide having sequence identity with integrins, wherein the polypeptide is designated in the present application as "PRO768".

In one embodiment, the invention provides an isolated nucleic acid molecule comprising DNA encoding a PRO768 polypeptide. In one aspect, the isolated nucleic acid comprises DNA encoding the PRO768 polypeptide having amino acid residues 1 through 1141 of FIG. 177 (SEQ ID NO:437), or is complementary to such encoding nucleic acid sequence, and remains stably bound to it under at least moderate, and optionally, under high stringency conditions. The isolated nucleic acid sequence may comprise the cDNA insert of the vector deposited on Apr. 6, 1998 as DNA55737-1345 which includes the nucleotide sequence encoding PRO768.

In another embodiment, the invention provides isolated PRO768 polypeptide. In particular, the invention provides isolated native sequence PRO768 polypeptide, which in one embodiment, includes an amino acid sequence comprising residues 1 through 1141 of FIG. 177 (SEQ ID NO:437). An additional embodiment of the present invention is directed to an isolated extracellular domain of a PRO768 polypeptide. Optionally, the PRO768 polypeptide is obtained or is obtainable by expressing the polypeptide encoded by the cDNA insert of the vector deposited on Apr. 6, 1998 as DNA55737-1345.

69. PRO771

Applicants have identified a cDNA clone that encodes a novel polypeptide having sequence identity with testican, wherein the polypeptide is designated in the present application as "PRO771".

In one embodiment, the invention provides an isolated nucleic acid molecule comprising DNA encoding a PRO771 polypeptide. In one aspect, the isolated nucleic acid comprises DNA encoding the PRO771 polypeptide having amino acid residues 1 through 436 of FIG. 179 (SEQ ID NO:442), or is complementary to such encoding nucleic acid sequence, and remains stably bound to it under at least moderate, and optionally, under high stringency conditions. The isolated nucleic acid sequence may comprise the cDNA insert of the vector deposited on Apr. 7, 1998 with the ATCC as DNA49829-1346 which includes the nucleotide sequence encoding PRO771.

In another embodiment, the invention provides isolated PRO771 polypeptide. In particular, the invention provides isolated native sequence PRO771 polypeptide, which in one embodiment, includes an amino acid sequence comprising residues 1 through 436 of FIG. 179 (SEQ ID NO:442). Optionally, the PRO771 polypeptide is obtained or is obtainable by expressing the polypeptide encoded by the cDNA insert of the vector deposited on Apr. 7, 1998 with the ATCC as DNA49829-1346.

70. PRO733

Applicants have identified a cDNA clone that encodes a novel polypeptide having sequence identity with the T1/ST2 receptor binding protein, wherein the polypeptide is designated in the present application as "PRO733".

In one embodiment, the invention provides an isolated nucleic acid molecule comprising DNA encoding a PRO733 polypeptide. In one aspect, the isolated nucleic acid comprises DNA encoding the PRO733 polypeptide having amino acid residues 1 through 229 of FIG. 181 (SEQ ID NO:447), or is complementary to such encoding nucleic acid sequence, and remains stably bound to it under at least moderate, and optionally, under high stringency conditions. The isolated nucleic acid sequence may comprise the cDNA insert of the vector deposited on Apr. 7, 1998 with the ATCC as DNA52196-1348 which includes the nucleotide sequence encoding PRO733.

In another embodiment, the invention provides isolated PRO733 polypeptide. In particular, the invention provides isolated native sequence PRO733 polypeptide, which in one embodiment, includes an amino acid sequence comprising residues 1 through 229 of FIG. 181 (SEQ ID NO:447). An additional embodiment of the present invention is directed to an isolated extracellular domain of a PRO733 polypeptide. Optionally, the PRO733 polypeptide is obtained or is obtainable by expressing the polypeptide encoded by the cDNA insert of the vector deposited on Apr. 7, 1998 as DNA52196-1348.

71. PRO162

Applicants have identified a cDNA clone that encodes a novel polypeptide having sequence identity with pancreatitis-associated protein, wherein the polypeptide is designated in the present application as "PRO162".

In one embodiment, the invention provides an isolated nucleic acid molecule comprising DNA encoding a PRO162 polypeptide. In one aspect, the isolated nucleic acid comprises DNA encoding the PRO162 polypeptide having amino acid residues 1 through 175 of FIG. 183 (SEQ ID NO:452), or is complementary to such encoding nucleic acid sequence, and remains stably bound to it under at least moderate, and optionally, under high stringency conditions. The isolated nucleic acid sequence may comprise the cDNA insert of the vector deposited on May 6, 1998 with the ATCC as DNA56965-1356 which includes the nucleotide sequence encoding PRO162.

In another embodiment, the invention provides isolated PRO162 polypeptide. In particular, the invention provides isolated native sequence PRO162 polypeptide, which in one embodiment, includes an amino acid sequence comprising residues 1 through 175 of FIG. 183 (SEQ ID NO:452). Optionally, the PRO162 polypeptide is obtained or is obtain-

72. PRO788

Applicants have identified a cDNA clone that encodes a novel polypeptide having sequence identity with anti-neoplastic urinary protein, wherein the polypeptide is designated in the present application as "PRO788".

In one embodiment, the invention provides an isolated nucleic acid molecule comprising DNA encoding a PRO788 polypeptide. In one aspect, the isolated nucleic acid comprises DNA encoding the PRO788 polypeptide having amino acid residues 1 through 125 of FIG. 185 (SEQ ID NO:454), or is complementary to such encoding nucleic acid sequence, and remains stably bound to it under at least moderate, and optionally, under high stringency conditions. The isolated nucleic acid sequence may comprise the cDNA insert of the vector deposited on May 6, 1998 with the ATCC as DNA56405-1357 which includes the nucleotide sequence encoding PRO788.

In another embodiment, the invention provides isolated PRO788 polypeptide. In particular, the invention provides isolated native sequence PRO788 polypeptide, which in one embodiment, includes an amino acid sequence comprising residues 1 through 125 of FIG. 185 (SEQ ID NO:454). An additional embodiment of the present invention is directed to an isolated extracellular domain of a PRO788 polypeptide. Optionally, the PRO788 polypeptide is obtained or is obtainable by expressing the polypeptide encoded by the cDNA insert of the vector deposited on May 6, 1998 with the ATCC as DNA56405-1357.

73. PRO1008

Applicants have identified a cDNA clone that encodes a novel polypeptide having sequence identity with dickkopf-1 (dkk-1), wherein the polypeptide is designated in the present application as "PRO1008".

In one embodiment, the invention provides an isolated nucleic acid molecule comprising DNA encoding a PRO1008 polypeptide. In one aspect, the isolated nucleic acid comprises DNA encoding the PRO1008 polypeptide having amino acid residues 1 through 266 of FIG. 187 (SEQ ID NO:456), or is complementary to such encoding nucleic acid sequence, and remains stably bound to it under at least moderate, and optionally, under high stringency conditions. The isolated nucleic acid sequence may comprise the cDNA insert of the vector deposited on May 20, 1998 with the ATCC as DNA57530-1375 which includes the nucleotide sequence encoding PRO1008.

In another embodiment, the invention provides isolated PRO1008 polypeptide. In particular, the invention provides isolated native sequence PRO1008 polypeptide, which in one embodiment, includes an amino acid sequence comprising residues 1 through 266 of FIG. 187 (SEQ ID NO:456). Optionally, the PRO1008 polypeptide is obtained or is obtainable by expressing the polypeptide encoded by the cDNA insert of the vector deposited on May 20, 1998 with the ATCC as DNA57530-1375.

In another embodiment, the invention provides an expressed sequence tag (EST) designated herein as DNA16508 comprising the nucleotide sequence of FIG. 188 (SEQ ID NO:457).

74. PRO1012

Applicants have identified a cDNA clone that encodes a novel polypeptide having sequence identity with disulfide isomerase and phospholipase C, wherein the polypeptide is designated in the present application as "PRO1012".

In one embodiment, the invention provides an isolated nucleic acid molecule comprising DNA encoding a PRO1012 polypeptide. In one aspect, the isolated nucleic acid comprises DNA encoding the PRO1012 polypeptide having amino acid residues 1 through 747 of FIG. 190 (SEQ ID NO:459), or is complementary to such encoding nucleic acid sequence, and remains stably bound to it under at least moderate, and optionally, under high stringency conditions. The isolated nucleic acid sequence may comprise the cDNA insert of the vector deposited on May 14, 1998 with the ATCC as DNA56439-1376, which includes the nucleotide sequence encoding PRO1012.

In another embodiment, the invention provides isolated PRO1012 polypeptide. In particular, the invention provides isolated native sequence PRO1012 polypeptide, which in one embodiment, includes an amino acid sequence comprising residues 1 through 747 of FIG. 190 (SEQ ID NO:459). Optionally, the PRO1012 polypeptide is obtained or is obtainable by expressing the polypeptide encoded by the cDNA insert of the vector deposited on May 14, 1998 with the ATCC as DNA56439-1376.

75. PRO1014

Applicants have identified a cDNA clone that encodes a novel polypeptide having sequence identity with reductase, wherein the polypeptide is designated in the present application as "PRO1014".

In one embodiment, the invention provides an isolated nucleic acid molecule comprising DNA encoding a PRO1014 polypeptide. In one aspect, the isolated nucleic acid comprises DNA encoding the PRO1014 polypeptide having amino acid residues 1 through 300 of FIG. 192 (SEQ ID NO:464), or is complementary to such encoding nucleic acid sequence, and remains stably bound to it under at least moderate, and optionally, under high stringency conditions. The isolated nucleic acid sequence may comprise the cDNA insert of the vector deposited on May 20, 1998 as DNA56409-1377 with the ATCC which includes the nucleotide sequence encoding PRO1014.

In another embodiment, the invention provides isolated PRO1014 polypeptide. In particular, the invention provides isolated native sequence PRO1014 polypeptide, which in one embodiment, includes an amino acid sequence comprising residues 1 through 300 of FIG. 192 (SEQ ID NO:464). Optionally, the PRO1014 polypeptide is obtained or is obtainable by expressing the polypeptide encoded by the cDNA insert of the vector deposited on May 20, 1998 as DNA56409-1377 with the ATCC.

76. PRO1017

Applicants have identified a cDNA clone that encodes a novel polypeptide having sequence identity with HNK-1 sulfotransferase, wherein the polypeptide is designated in the present application as "PRO1017".

In one embodiment, the invention provides an isolated nucleic acid molecule comprising DNA encoding a PRO1017 polypeptide. In one aspect, the isolated nucleic acid comprises DNA encoding the PRO1017 polypeptide having amino acid residues 1 through 414 of FIG. 194 (SEQ ID NO:466), or is complementary to such encoding nucleic acid sequence, and remains stably bound to it under at least moderate, and optionally, under high stringency conditions. The isolated nucleic acid sequence may comprise the cDNA insert of the vector deposited on May 20, 1998 with the ATCC as DNA56112-1379 which includes the nucleotide sequence encoding PRO1017.

In another embodiment, the invention provides isolated PRO1017 polypeptide. In particular, the invention provides isolated native sequence PRO1017 polypeptide, which in one embodiment, includes an amino acid sequence comprising residues 1 through 414 of FIG. 194 (SEQ ID NO:466). Optionally, the PRO1017 polypeptide is obtained or is obtainable by expressing the polypeptide encoded by the cDNA insert of the vector deposited on May 20, 1998 with the ATCC as DNA56112-1379.

77. PRO474

Applicants have identified a cDNA clone that encodes a novel polypeptide having sequence identity with dehydrogenase, wherein the polypeptide is designated in the present application as "PRO474".

In one embodiment, the invention provides an isolated nucleic acid molecule comprising DNA encoding a PRO474 polypeptide. In one aspect, the isolated nucleic acid comprises DNA encoding the PRO474 polypeptide having amino acid residues 1 through 270 of FIG. 196 (SEQ ID NO:468), or is complementary to such encoding nucleic acid sequence, and remains stably bound to it under at least moderate, and optionally, under high stringency conditions. The isolated nucleic acid sequence may comprise the cDNA insert of the vector deposited on May 14, 1998 with the ATCC as DNA56045-1380 which includes the nucleotide sequence encoding PRO474.

In another embodiment, the invention provides isolated PRO474 polypeptide. In particular, the invention provides isolated native sequence PRO474 polypeptide, which in one embodiment, includes an amino acid sequence comprising residues 1 through 270 of FIG. 196 (SEQ ID NO:468). Optionally, the PRO474 polypeptide is obtained or is obtainable by expressing the polypeptide encoded by the cDNA insert of the vector deposited on May 14, 1998 with the ATCC as DNA56045-1380.

78. PRO1031

Applicants have identified a cDNA clone that encodes a novel polypeptide having sequence identity with IL-17, wherein the polypeptide is designated in the present application as "PRO1031".

In one embodiment, the invention provides an isolated nucleic acid molecule comprising DNA encoding a PRO1031 polypeptide. In one aspect, the isolated nucleic acid comprises DNA encoding the PRO1031 polypeptide having amino acid residues 1 through 180 of FIG. 198 (SEQ ID NO:470), or is complementary to such encoding nucleic acid sequence, and remains stably bound to it under at least moderate, and optionally, under high stringency conditions. The isolated nucleic acid sequence may comprise the cDNA insert of the vector deposited on May 14, 1998 with the ATCC as DNA59294-1381 which includes the nucleotide sequence encoding PRO1031.

In another embodiment, the invention provides isolated PRO1031 polypeptide. In particular, the invention provides isolated native sequence PRO1031 polypeptide, which in one embodiment, includes an amino acid sequence comprising residues 1 through 180 of FIG. 198 (SEQ ID NO:470). Optionally, the PRO1031 polypeptide is obtained or is obtainable by expressing the polypeptide encoded by the cDNA insert of the vector deposited on May 14, 1998 with the ATCC as DNA59294-1381.

79. PRO938

Applicants have identified a cDNA clone that encodes a novel polypeptide having sequence identity to protein disulfide isomerase, wherein the polypeptide is designated in the present application as "PRO938".

In one embodiment, the invention provides an isolated nucleic acid molecule comprising DNA encoding a PRO938 polypeptide. In one aspect, the isolated nucleic acid comprises DNA encoding the PRO938 polypeptide having amino acid residues 1 to 349 of FIG. 200 (SEQ ID NO:472), or is complementary to such encoding nucleic acid sequence, and remains stably bound to it under at least moderate, and optionally, under high stringency conditions. In other aspects, the isolated nucleic acid comprises DNA encoding the PRO938 polypeptide having amino acid residues about 23 to 349 of FIG. 200 (SEQ ID NO:472) or amino acid 1 or about 23 to X of FIG. 200 (SEQ ID NO:472), where X is any amino acid from 186 to 195 of FIG. 200 (SEQ ID NO:472), or is complementary to such encoding nucleic acid sequence, and remains stably bound to it under at least moderate, and optionally, under high stringency conditions. The isolated nucleic acid sequence may comprise the cDNA insert of the DNA56433-1406 vector deposited on May 12, 1998, as ATCC Accession No. 209857 which includes the nucleotide sequence encoding PRO938.

In another embodiment, the invention provides isolated PRO938 polypeptide. In particular, the invention provides isolated native sequence PRO938 polypeptide, which in one embodiment, includes an amino acid sequence comprising residues 1 to 349 of FIG. 200 (SEQ ID NO:472). Additional embodiments of the present invention are directed to PRO938 polypeptides comprising amino acids about 23 to 349 of FIG. 200 (SEQ ID NO:472) or amino acid 1 or about 23 to X of FIG. 200 (SEQ ID NO:472), where X is any amino acid from 186 to 195 of FIG. 200 (SEQ ID NO:472). Optionally, the PRO938 polypeptide is obtained or is obtainable by expressing the polypeptide encoded by the cDNA insert of the DNA56433-1406 vector deposited on May 12, 1998, as ATCC Accession No. 209857.

80. PRO1082

Applicants have identified a cDNA clone that encodes a novel polypeptide having sequence identity with a lectin-like oxidized LDL receptor, wherein the polypeptide is designated in the present application as "PRO1082".

In one embodiment, the invention provides an isolated nucleic acid molecule comprising DNA encoding a PRO1082 polypeptide. In one aspect, the isolated nucleic acid comprises DNA encoding the PRO1082 polypeptide having amino acid residues 1 through 201 of FIG. 202 (SEQ ID NO:477), or is complementary to such encoding nucleic acid sequence, and remains stably bound to it under at least moderate, and optionally, under high stringency conditions. The isolated nucleic acid sequence may comprise the cDNA insert of the vector deposited on May 14, 1998 with the ATCC as DNA53912-1457 which includes the nucleotide sequence encoding PRO1082.

In another embodiment, the invention provides isolated PRO1082 polypeptide. In particular, the invention provides isolated native sequence PRO1082 polypeptide, which in one embodiment, includes an amino acid sequence comprising residues 1 through 201 of FIG. 202 (SEQ ID NO:477). An additional embodiment of the present invention is directed to an isolated domain of a PRO1082 polypeptide, excluding the transmembrane domain. Optionally, the PRO1082 polypeptide is obtained or is obtainable by expressing the polypeptide encoded by the cDNA insert of the vector deposited on May 14, 1998 with the ATCC as DNA53912-1457.

81. PRO1083

Applicants have identified a cDNA clone that encodes a novel polypeptide having sequence identity with a 7TM receptor, latrophilin-related protein 1, and a macrophage restricted cell surface glycoprotein, wherein the polypeptide is designated in the present application as "PRO1083".

In one embodiment, the invention provides an isolated nucleic acid molecule comprising DNA encoding a PRO1083 polypeptide. In one aspect, the isolated nucleic acid comprises DNA encoding the PRO1083 polypeptide having amino acid residues 1 through 693 of FIG. 204 (SEQ ID NO:483), or is complementary to such encoding nucleic acid sequence, and remains stably bound to it under at least moderate, and optionally, under high stringency conditions. The isolated nucleic acid sequence may comprise the cDNA insert of the vector deposited on May 12, 1998 with the ATCC as DNA50921-1458 which includes the nucleotide sequence encoding PRO1083.

In another embodiment, the invention provides isolated PRO1083 polypeptide. In particular, the invention provides isolated native sequence PRO1083 polypeptide, which in one embodiment, includes an amino acid sequence comprising residues 1 through 693 of FIG. 204 (SEQ ID NO:483). An additional embodiment of the present invention is directed to an isolated extracellular domain of a PRO1083 polypeptide. Optionally, the PRO1083 polypeptide is obtained or is obtainable by expressing the polypeptide encoded by the cDNA insert of the vector deposited on May 12, 1998 with the ATCC as DNA50921-1458.

In another embodiment, the invention provides an expressed sequence tag (EST) designated herein as DNA24256 which comprises the nucleotide sequence of FIG. 205 (SEQ ID NO:484).

82. PRO200

The objects of this invention, as defined generally supra, are achieved at least in part by the provision of a novel polypeptide, VEGF-E also herein designated PRO200, (SEQ ID NO:488) and the nucleic acid encoding therefor, SEQ ID NO:487, residues 259 through 1293.

In one embodiment, the invention provides an isolated nucleic acid molecule comprising DNA encoding a VEGF-E polypeptide. In one aspect, the isolated nucleic acid comprises DNA encoding the VEGF-E polypeptide having amino acid residues 1 through 345 of FIG. 207 (SEQ ID NO:488), or is complementary to such encoding nucleic acid sequence, and remains stably bound to it under low stringency conditions. In another embodiment, variants are provided wherein the VEGF-E nucleic acid has single or multiple deletions, substitutions, insertions, truncations or combinations thereof.

In another embodiment, the invention provides isolated VEGF-E polypeptide. In particular, the invention provides an isolated native sequence VEGF-E polypeptide, which in one embodiment, includes an amino acid sequence comprising residues 1 through 345 of FIG. 207 (SEQ ID NO:488). In another embodiment, variants are provided wherein the VEGF-E polypeptide has single or multiple deletions, substitutions, insertions, truncations or combinations thereof.

In yet further embodiments, the present invention is directed to compositions useful for treating indications where proliferation, survival and/or differentiation of cells is desired, comprising a therapeutically effective amount of a VEGF-E polypeptide hereof in admixture with a pharmaceutically acceptable carrier.

The invention further includes associated embodiments of VEGF-E such as modified VEGF-E polypeptides and modified variants which have the same biological applications as VEGF-E, and pharmaceutical compositions incorporating same. Inhibitors of VEGF-E are also provided.

83. PRO285 and PRO286

Applicants have identified two novel cDNA clones that encode novel human Toll polypeptides, designated in the present application as PRO285 (encoded by DNA40021-1154) and PRO286 (encoded by DNA42663-1154).

In one embodiment, the invention provides an isolated nucleic acid molecule comprising a DNA encoding a polypeptide having at least about 80% sequence identity, preferably at least about 85% sequence identity, more preferably at least about 90% sequence identity, most preferably at least about 95% sequence identity to (a) a DNA molecule encoding a PRO285 polypeptide having amino acid residues 27 to 839 of FIG. 209 (SEQ ID NO:496); or (b) to a DNA molecule encoding a PRO286 polypeptide having amino acid residues 27 to 825 of FIG. 211 (SEQ ID NO:498) or (c) the complement of the DNA molecule of (a) or (b). The complementary DNA molecule preferably remains stably bound to such encoding nucleic acid sequence under at least moderate, and optionally, under high stringency conditions.

In a further embodiment, the isolated nucleic acid molecule comprises a polynucleotide that has at least about 90%, preferably at least about 95% sequence identity with a polynucleotide encoding a polypeptide comprising the sequence of amino acids 1 to 839 of FIG. 209 (SEQ ID NO:496); or at least about 90%, preferably at least about 95% sequence identity with a polynucleotide encoding a polypeptide comprising the sequence of amino acids 1 to 1041 of FIG. 211 (SEQ ID NO:498).

In a specific embodiment, the invention provides an isolated nucleic acid molecule comprising DNA encoding native or variant PRO285 and PRO286 polypeptides, with or without the N-terminal signal sequence, and with or without the transmembrane regions of the respective full-length sequences. In one aspect, the isolated nucleic acid comprises DNA encoding a mature, full-length native PRO285 or PRO286 polypeptide having amino acid residues 1 to 1049 of FIG. 209 (SEQ ID NO:496) and 1 to 1041 of FIG. 211 (SEQ ID NO:498), or is complementary to such encoding nucleic acid sequence. In another aspect, the invention concerns an isolated nucleic acid molecule that comprises DNA encoding a native PRO285 or PRO286 polypeptide without an N-terminal signal sequence, or is complementary to such encoding nucleic acid sequence. In yet another embodiment, the invention concerns nucleic acid encoding transmembrane-domain deleted or inactivated forms of the full-length native PRO285 or PRO286 proteins.

In another embodiment, the invention the isolated nucleic acid molecule comprises the clone (DNA40021-1154) deposited on Oct. 17, 1997, under ATCC number 209389; or the clone (DNA42663-1154) deposited on Oct. 17, 1997, under ATCC number 209386.

In yet another embodiment, the invention provides a vector comprising DNA encoding PRO285 and PRO286 polypeptides, or their variants. Thus, the vector may comprise any of the isolated nucleic acid molecules hereinabove defined.

In another embodiment, the invention provides isolated PRO285 and PRO286 polypeptides. In particular, the invention provides isolated native sequence PRO285 and PRO286 polypeptides, which in one embodiment, include the amino acid sequences comprising residues 1 to 1049 and 1 to 1041 of FIGS. 209 and 211 (SEQ ID NOS: 496 and 498), respectively. The invention also provides for variants of the PRO285 and PRO286 polypeptides which are encoded by any of the isolated nucleic acid molecules hereinabove defined. Specific variants include, but are not limited to, deletion (truncated) variants of the full-length native sequence PRO285 and PRO286 polypeptides which lack the respective N-terminal signal sequences and/or have their respective transmembrane and/or cytoplasmic domains deleted or inactivated.

The invention also specifically includes antibodies with dual specificities, e.g., bispecific antibodies binding more than one Toll polypeptide.

In yet another embodiment, the invention concerns agonists and antagonists of the native PRO285 and PRO286 polypeptides. In a particular embodiment, the agonist or antagonist is an anti-PRO285 or anti-PRO286 antibody.

In a further embodiment, the invention concerns screening assays to identify agonists or antagonists of the native PRO285 and PRO286 polypeptides.

In a still further embodiment, the invention concerns a composition comprising a PRO285 or PRO286 polypeptide, or an agonist or antagonist as hereinabove defined, in combination with a pharmaceutically acceptable carrier.

The invention further concerns a composition comprising an antibody specifically binding a PRO285 or PRO286 polypeptide, in combination with a pharmaceutically acceptable carrier.

The invention also concerns a method of treating septic shock comprising administering to a patient an effective amount of an antagonist of a PRO285 or PRO286 polypeptide. In a specific embodiment, the antagonist is a blocking antibody specifically binding a native PRO285 or PRO286 polypeptide.

84. PRO213-1, PRO1330 and PRO1449

The present invention concerns compositions and methods for the diagnosis and treatment of neoplastic cell growth and proliferation in mammals, including humans. The present invention is based on the identification of genes that are amplified in the genome of tumor cells. Such gene amplification is expected to be associated with the overexpression of the gene product and contribute to tumorigenesis. Accordingly, the proteins encoded by the amplified genes are believed to be useful targets for the diagnosis and/or treatment (including prevention) of certain cancers, and may act as predictors of the prognosis of tumor treatment.

In one embodiment, the present invention provides an isolated nucleic acid molecule comprising DNA encoding a PRO213-1, PRO1330 and/or PRO1449 polypeptide. In one aspect, the isolated nucleic acid comprises DNA encoding the PRO213-1, PRO1330 and/or PRO1449 polypeptide having amino acid residues 1 to 295 of FIG. 213 (SEQ ID NO:506), 20 to 273 of FIG. 215 (SEQ ID NO:508) and 20 to 273 of FIG. 217 (SEQ ID NO:510), respectively, or is complementary to such encoding nucleic acid sequence, and remains stably bound to it under at least moderate, and optionally, under high stringency conditions. The isolated nucleic acid sequence may comprise the cDNA insert of the vector designated as DNA30943-1163 (ATCC 209791) deposited on Apr. 21, 1998; DNA64907-1163-1 (ATCC 203242) deposited on Sep. 9, 1998 and/or DNA64908-1163-1 (ATCC 203243) deposited on Sep. 9, 1998.

In another embodiment, the present invention comprises an isolated nucleic acid molecule having at least about 80% sequence identity, preferably at least about 85% sequence identity, more preferably at least about 90% sequence identity, most preferably at least about 95% sequence identity to (a) a DNA molecule encoding a PRO213-1, PRO1330 and/or PRO1449 polypeptide having amino acid residues 1 to 295 of FIG. 213 (SEQ ID NO:506), 20 to 273 of FIG. 215 (SEQ ID NO:508) and 20 to 273 of FIG. 217 (SEQ ID NO:510), respectively; or (b) the complement of the DNA molecule of (a).

In another embodiment, the invention provides an isolated PRO213-1, PRO1330 and/or PRO1449 polypeptide. In particular, the invention provides isolated native sequence PRO213-1, PRO1330 and/or PRO1449 polypeptide, which in one embodiment, includes an amino acid sequence comprising residues 1 to 295 of FIG. 213 (SEQ ID NO:506), 20 to 273 of FIG. 215 (SEQ ID NO:508) or 20 to 273 of FIG. 217 (SEQ ID NO:510), respectively. Optionally, the PRO213-1, PRO1330 and/or PRO1449 polypeptide is obtained or obtainable by expressing the polypeptide encoded by the cDNA insert of the DNA30943-1163 (ATCC 209791), DNA64907-1163-1 (ATCC 203242) or DNA64908-1163-1 (ATCC 203243).

In another aspect, the invention provides an isolated PRO213-1, PRO1330, and/or PRO1449 polypeptide, comprising an amino acid sequence having at least about 80% sequence identity, preferably at least about 85% sequence identity, more preferably at least about 95% sequence identity to amino acid residues 1 to 295 of FIG. 213 (SEQ ID NO:506), 20 to 273 of FIG. 215 (SEQ ID NO:508) or 20 to 273 of FIG. 217 (SEQ ID NO:510), inclusive.

In yet another embodiment, the invention provides an isolated PRO213-1, PRO1330, and/or PRO1449 polypeptide, comprising the amino acid residues 1 to 295 of FIG. 213 (SEQ ID NO:506), 20 to 273 of FIG. 215 (SEQ ID NO:508) or 20 to 273 of FIG. 217 (SEQ ID NO:510), or a fragment thereof sufficient to provide a binding site for an anti-PRO213-1, anti-PRO1330 and/or anti-PRO1449 antibody. Preferably, the PRO213-1, PRO1330, and/or PRO1449 fragment retains a qualitative biological activity of a native PRO213-1, PRO1330, and/or PRO1449 polypeptide.

In a further aspect, the invention concerns an isolated PRO213-1, PRO1330, and/or PRO1449 polypeptide, comprising an amino acid sequence scoring at least about 80% positives, preferably at least about 85% positives, more preferably at least about 90% positives, most preferably at least about 95% positives when compared with the amino acid sequence of residues 1 to 295 of FIG. 213 (SEQ ID NO:506), 20 to 273 of FIG. 215 (SEQ ID NO:508) and 20 to 273 of FIG. 217 (SEQ ID NO:510), respectively.

In still a further aspect, the invention provides a polypeptide produced by (i) hybridizing a test DNA molecule under stringent conditions with: (a) a DNA molecule encoding a PRO213-1, PRO1330, and/or PRO1449 polypeptide having the amino acid residues from 1 to 295 of FIG. 213 (SEQ ID NO:506), 20 to 273 of FIG. 215 (SEQ ID NO:508) and 20 to 273 of FIG. 217 (SEQ ID NO:510), respectively; or the complement of the DNA molecule of (a), and if said test DNA molecule has at least about an 80% sequence identity to (a) or (b), (ii) culturing a host cell comprising said test DNA molecule under conditions suitable for the expression of said polypeptide, and (iii) recovering said polypeptide from the cell culture.

In one embodiment, the present invention concerns an isolated antibody which binds a PRO213-1, PRO1330 and/or PRO1449 polypeptide. In one aspect, the antibody induces death of a cell overexpressing a PRO213-1, PRO1330 and/or PRO1449 polypeptide. In another aspect, the antibody is a monoclonal antibody, which preferably has nonhuman complementarity determining region (CDR) residues and human framework region (FR) residues. The antibody may be labeled and may be immobilized on a solid support. In a further aspect, the antibody is an antibody fragment, a single-chain antibody, or an anti-idiotypic antibody.

In another embodiment, the invention concerns a composition comprising an antibody which binds a PRO213-1, PRO1330 and/or PRO1449 polypeptide in admixture with a pharmaceutically acceptable carrier. In one aspect, the composition comprises a therapeutically effective amount of the antibody. In another aspect, the composition comprises a further active ingredient, which may, for example, be a further antibody or a cytotoxic or chemotherapeutic agent. Preferably, the composition is sterile.

In a further embodiment, the invention concerns nucleic acid encoding an anti-PRO213-1, anti-PRO1330 and/or anti-PRO1449 antibody, and vectors and recombinant host cells comprising such nucleic acid.

The invention further concerns antagonists and agonists of a PRO213-1, PRO1330 and/or PRO1449 polypeptide that inhibit one or more of the functions or activities of the PRO213-1, PRO1330 and/or PRO1449 polypeptide.

In a further embodiment, the invention concerns isolated nucleic acid molecules that hybridize to the complement of the nucleic acid molecules encoding the PRO213-1, PRO1330 and/or PRO1449 polypeptides. The nucleic acid preferably is DNA, and hybridization preferably occurs under stringent conditions. Such nucleic acid molecules can act as antisense molecules of the amplified genes identified herein, which, in turn, can find use in the modulation of the respective amplified genes, or as antisense primers in amplification reactions. Furthermore, such sequences can be used as part of ribozyme and/or triple helix sequence which, in turn, may be used in regulation of the amplified genes.

In another embodiment, the invention concerns a method for determining the presence of a PRO213-1, PRO1330 and/or PRO1449 polypeptide comprising exposing a cell suspected of containing the PRO213-1, PRO1330 and/or PRO1449 polypeptide to an anti-PRO213-1, PRO1330 and/or PRO1449 antibody and determining binding of the antibody to the cell.

In yet another embodiment, the present invention concerns a method of diagnosing tumor in a mammal, comprising detecting the level of expression of a gene encoding a PRO213-1, PRO1330 and/or PRO1449 polypeptide (a) in a test sample of tissue cells obtained from the mammal, and (b) in a control sample of known normal tissue cells of the same cell type, wherein a higher expression level in the test sample indicates the presence of tumor in the mammal from which the test tissue cells were obtained.

In another embodiment, the present invention concerns a method of diagnosing tumor in a mammal, comprising (a) contacting an anti-PRO213-1, anti-PRO1330 and/or anti-PRO1449 antibody with a test sample of tissue cells obtained from the mammal, and (b) detecting the formation of a complex between the anti-PRO213-1, anti-PRO1330 and/or anti-PRO1449 antibody and the PRO213-1, PRO1330 and/or PRO1449 polypeptide in the test sample. The detection may be qualitative or quantitative, and may be performed in comparison with monitoring the complex formation in a control sample of known normal tissue cells of the same cell type. A larger quantity of complexes formed in the test sample indicates the presence of tumor in the mammal from which the test tissue cells were obtained. The antibody preferably carries a detectable label. Complex formation can be monitored, for example, by light microscopy, flow cytometry, fluorimetry, or other techniques known in the art. The test sample is usually obtained from an individual suspected to have neoplastic cell growth or proliferation (e.g. cancerous cells).

In another embodiment, the present invention concerns a cancer diagnostic kit, comprising an anti-PRO213-1, anti-PRO1330 and/or anti-PRO1449 antibody and a carrier (e.g. a buffer) in suitable packaging. The kit preferably contains instructions for using the antibody to detect the PRO213-1, PRO1330 and/or PRO1449 polypeptide.

In yet another embodiment, the invention concerns a method for inhibiting the growth of tumor cells comprising exposing a cell which overexpresses a PRO213-1, PRO1330 and/or PRO1449 polypeptide to an effective amount of an agent inhibiting the expression and/or activity of the PRO213-1, PRO1330 and/or PRO1449 polypeptide. The agent preferably is an anti-PRO213-1, anti-PRO1330 and/or anti-PRO1449 antibody, a small organic and inorganic molecule, peptide, phosphopeptide, antisense or ribozyme molecule, or a triple helix molecule. In a specific aspect, the agent, e.g. anti-PRO213-1, anti-PRO1330 and/or anti-PRO1449 antibody induces cell death. In a further aspect, the tumor cells are further exposed to radiation treatment and/or a cytotoxic or chemotherapeutic agent.

In a further embodiment, the invention concerns an article of manufacture, comprising:

a) a container;

b) a label on the container; and c) a composition comprising an active agent contained within the container; wherein the composition is effective for inhibiting the growth of tumor cells, the label on the container indicates that the composition can be used for treating conditions characterized by overexpression of a PRO213-1, PRO1330 and/or PRO1449 polypeptide, and the active agent in the composition is an agent inhibiting the expression and/or activity of the PRO213-1, PRO1330 and/or PRO1449 polypeptide. In a preferred aspect, the active agent is an anti-PRO213-1, anti-PRO1330 and/or anti-PRO1449 antibody.

In yet a further embodiment, the invention provides a method for identifying a compound capable of inhibiting the expression and/or activity of a PRO213-1, PRO1330 and/or PRO1449 polypeptide, comprising contacting a candidate compound with a PRO213-1, PRO1330 and/or PRO1449 polypeptide under conditions and for a time sufficient to allow these two components to interact. In a specific aspect, either the candidate compound or the PRO213-1, PRO1330 and/or PRO1449 polypeptide is immobilized on a solid support. In another aspect, the non-immobilized component carries a detectable label.

85. PRO298

Applicants have identified a cDNA clone that encodes a novel polypeptide. The DNA is designated in the present application as "DNA39975-1210", encoding a novel multi-transmembrane protein, referred to as "PRO298".

In one embodiment, the invention provides an isolated nucleic acid molecule comprising DNA having at least about 80%, preferably at least about 85%, more preferably at least about 90%, most preferably at least about 95% sequence identity to (a) a DNA molecule encoding PRO298, comprising the sequence of amino acids 1 to 364 of FIG. 219 (SEQ ID NO:515), or (b) the complement of the DNA molecule of (a). In one aspect, the isolated nucleic acid comprises DNA encoding a PRO298 polypeptide having amino acid residues 1 to 364 of FIG. 219 (SEQ ID NO:515), or is complementary to such encoding nucleic acid sequence, and remains stably bound to it under at least moderate, and optionally, under high stringency conditions.

In a further embodiment, the invention concerns an isolated nucleic acid molecule comprising DNA having at least an 80% sequence identity to (a) a DNA molecule encoding the same mature polypeptide encoded by the human protein cDNA in ATCC Deposit No. 209783 (DNA39975-1210), or (b) the complement of the DNA molecule of (a).

In a still further embodiment, the invention concerns nucleic acid which comprises a DNA molecule encoding the same mature polypeptide encoded by the human protein cDNA in ATCC Deposit No. 209783 (DNA39975-1210).

In another embodiment, the invention provides isolated PRO298 polypeptide. In particular, the invention provides isolated native sequence PRO298 polypeptide, which in one embodiment, includes an amino acid sequence comprising residues 1 to 364 of FIG. 219 (SEQ ID NO:515).

In another embodiment, the invention provides an expressed sequence tag (EST) designated DNA26832 comprising the nucleotide sequence of FIG. 220 (SEQ ID NO:516).

86. PRO337

Applicants have identified a cDNA clone (DNA43316-1237) that encodes a novel polypeptide, designated in the present application as "PRO337".

In one embodiment, the invention provides an isolated nucleic acid molecule having at least about 80% sequence identity to (a) a DNA molecule encoding a PRO337 polypeptide comprising the sequence of amino acids 1 to 344 of FIG. 222 (SEQ ID NO:523), or (b) the complement of the DNA molecule of (a). The sequence identity preferably is about 85%, more preferably about 90%, most preferably about 95%. In one aspect, the isolated nucleic acid has at least about 80%, preferably at least about 85%, more preferably at least about 90%, and most preferably at least about 95 (including 96, 97, 98 and 99%) sequence identity with a polypeptide having amino acid residues 1 to 344 of FIG. 222 (SEQ ID NO:523). Preferably, the highest degree of sequence identity occurs within the immunoglobulin and major histocompatibility domains (amino acids 113 to 130 of FIG. 222, SEQ ID NO:523).

In a further embodiment, the isolated nucleic acid molecule comprises DNA encoding a neurotrimin polypeptide having amino acid residues 1 to 344 of FIG. 222 (SEQ ID NO:523), or is complementary to such encoding nucleic acid sequence, and remains stably bound to it under at least moderate, and optionally, under high stringency conditions. In another aspect, the invention provides a nucleic acid of the full length protein of clone DNA43316-1237, deposited with the ATCC under accession number ATCC 209487, alternatively the coding sequence of clone DNA43316-1237, deposited under accession number ATCC 209487.

In yet another embodiment, the invention provides isolated PRO337 polypeptide. In particular, the invention provides isolated native sequence PRO337 polypeptide, which in one embodiment, includes an amino acid sequence comprising residues 1 to 344 of FIG. 222 (SEQ ID NO:523). Native PRO337 polypeptides with or without the native signal sequence (amino acids 1 to about 28 in FIG. 222 (SEQ ID NO:523), and with or without the initiating methionine are specifically included. Alternatively, the invention provides a PRO337 polypeptide encoded by the nucleic acid deposited under accession number ATCC 209487.

In yet another embodiment, the invention provides an expressed sequence tag (EST) comprising the nucleotide sequences identified in FIG. 223 as DNA42301 (SEQ ID NO:524).

87. PRO403

Applicants have identified a cDNA clone (DNA55800-1263) that encodes a novel polypeptide, designated in the present application as "PRO403".

In one embodiment, the invention provides an isolated nucleic acid molecule having at least about 80% sequence identity to (a) a DNA molecule encoding a PRO403 polypeptide comprising the sequence of amino acids 1 to 736 of FIG. 225 (SEQ ID NO:526), or (b) the complement of the DNA molecule of (a). The sequence identity preferably is about 85%, more preferably about 90%, most preferably about 95%. In one aspect, the isolated nucleic acid has at least about 80%, preferably at least about 85%, more preferably at least about 90%, and most preferably at least about 95% sequence identity with a polypeptide having amino acid residues 1 to 736 of FIG. 225 (SEQ ID NO:526). Preferably, the highest degree of sequence identity occurs within: (1) the putative N-glycosylatation sites (amino acid residues 132, 136, 177, 237, 282, 349, 505, 598 and 606; (2) Cys residues conserved with the Kell blood group protein family (amino acid residues 65, 70, 88 and 96) and the putative zinc binding motif (amino acid residues 570–579).

In a further embodiment, the isolated nucleic acid molecule comprises DNA encoding a PRO403 polypeptide having amino acid residues 1 to 736 of FIG. 225 (SEQ ID NO:526), or is complementary to such encoding nucleic acid sequence, and remains stably bound to it under at least moderate, and optionally, under high stringency conditions. In another aspect, the invention provides a nucleic acid of the full length protein of clone DNA55800-1263, deposited with the ATCC under accession number ATCC 209680, alternatively the coding sequence of clone DNA55800-1263, deposited under accession number ATCC 209680.

In yet another embodiment, the invention provides isolated PRO403 polypeptide. In particular, the invention provides isolated native sequence PRO403 polypeptide, which in one embodiment, includes an amino acid sequence comprising residues 1 to 736 of FIG. 225 (SEQ ID NO:526). Native PRO403 polypeptides with or the initiating methionine are specifically included. Alternatively, the invention provides a PRO403 polypeptide encoded by the nucleic acid deposited under accession number ATCC 209680.

In yet another embodiment, the invention provides an expressed sequence tag (EST) and other sequence fragments comprising the nucleotide sequences identified herein as DNA34415 (FIG. 226; SEQ ID NO:527); DNA49830 (FIG. 227; SEQ ID NO:528) and DNA49831 (FIG. 228; SEQ ID NO:529).

88. Additional Embodiments

In other embodiments of the present invention, the invention provides vectors comprising DNA encoding any of the herein described polypeptides. Host cell comprising any such vector are also provided. By way of example, the host cells may be CHO cells, *E. coli*, or yeast. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In another embodiment, the invention provides an antibody which specifically binds to any of the above or below described polypeptides. Optionally, the antibody is a monoclonal antibody, humanized antibody, antibody fragment or single-chain antibody.

In yet other embodiments, the invention provides oligonucleotide probes useful for isolating genomic and cDNA nucleotide sequences or as antisense probes, wherein those probes may be derived from any of the above or below described nucleotide sequences.

In other embodiments, the invention provides an isolated nucleic acid molecule comprising a nucleotide sequence that encodes a PRO polypeptide.

In one aspect, the isolated nucleic acid molecule comprises a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule encoding a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein, or (b) the complement of the DNA molecule of (a).

In other aspects, the isolated nucleic acid molecule comprises a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule comprising the coding sequence of a full-length PRO polypeptide cDNA as disclosed herein, the coding sequence of a PRO polypeptide lacking the signal peptide as disclosed herein, the coding sequence of an extracellular domain of a transmembrane PRO polypeptide, with or without the signal peptide, as disclosed herein or the coding sequence of any other specifically defined fragment of the full-length amino acid sequence as disclosed herein, or (b) the complement of the DNA molecule of (a).

In a further aspect, the invention concerns an isolated nucleic acid molecule comprising a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule that encodes the same mature polypeptide encoded by any of the human protein cDNAs deposited with the ATCC as disclosed herein, or (b) the complement of the DNA molecule of (a).

Another aspect the invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence, or the complement thereof, that may find use as, for example, hybridization probes, for encoding fragments of a PRO polypeptide that may optionally encode a polypeptide comprising a binding site for an anti-PRO antibody or as antisense oligonucleotide probes. Such nucleic acid fragments are usually at least about 20 nucleotides in length, preferably at least about 30 nucleotides in length, more preferably at least about 40 nucleotides in length, yet more preferably at least about 50 nucleotides in length, yet more preferably at least about 60 nucleotides in length, yet more preferably at least about 70 nucleotides in length, yet more preferably at least about 80 nucleotides in length, yet more preferably at least about 90 nucleotides in length, yet more preferably at least about 100 nucleotides in length, yet more preferably at least about 110 nucleotides in length, yet more preferably at least about 120 nucleotides in length, yet more preferably at least about 130 nucleotides in length, yet more preferably at least about 140 nucleotides in length, yet more preferably at least about 150 nucleotides in length, yet more preferably at least about 160 nucleotides in length, yet more preferably at least about 170 nucleotides in length, yet more preferably at least about 180 nucleotides in length, yet more preferably at least about 190 nucleotides in length, yet more preferably at least about 200 nucleotides in length, yet more preferably at least about 250 nucleotides in length, yet more preferably at least about 300 nucleotides in length, yet more preferably at least about 350 nucleotides in length, yet more preferably at least about 400 nucleotides in length, yet more preferably at least about 450 nucleotides in length, yet more preferably at least about 500 nucleotides in length, yet more preferably at least about 600 nucleotides in length, yet more preferably at least about 700 nucleotides in length, yet more preferably at least about 800 nucleotides in length, yet more preferably at least about 900 nucleotides in length and yet more preferably at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides isolated PRO polypeptide encoded by any of the isolated nucleic acid sequences hereinabove identified.

In a certain aspect, the invention concerns an isolated PRO polypeptide, comprising an amino acid sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a further aspect, the invention concerns an isolated PRO polypeptide comprising an amino acid sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to an amino acid sequence encoded by any of the human protein cDNAs deposited with the ATCC as disclosed herein.

In a further aspect, the invention concerns an isolated PRO polypeptide comprising an amino acid sequence scoring at least about 80% positives, preferably at least about 81% positives, more preferably at least about 82% positives, yet more preferably at least about 83% positives, yet more preferably at least about 84% positives, yet more preferably at least about 85% positives, yet more preferably at least about 86% positives, yet more preferably at least about 87% positives, yet more preferably at least about 88% positives, yet more preferably at least about 89% positives, yet more preferably at least about 90% positives, yet more preferably at least about 91% positives, yet more preferably at least about 92% positives, yet more preferably at least about 93% positives, yet more preferably at least about 94% positives, yet more preferably at least about 95% positives, yet more preferably at least about 96% positives, yet more preferably at least about 97% positives, yet more preferably at least about 98% positives and yet more preferably at least about 99% positives when compared with the amino acid sequence of a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a specific aspect, the invention provides an isolated PRO polypeptide without the N-terminal signal sequence and/or the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention concerns agonists and antagonists of a native PRO polypeptide as defined herein. In a particular embodiment, the agonist or antagonist is an anti-PRO antibody or a small molecule.

In a further embodiment, the invention concerns a method of identifying agonists or antagonists to a PRO polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention concerns a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as hereinbefore described, or an anti-PRO antibody, for the preparation of a medicament useful in the treatment of a condition which is responsive to the PRO polypeptide, an agonist or antagonist thereof or an anti-PRO antibody.

BRIEF DESCRIPTION OF THE DRAWINGS

FIG. 1 shows a nucleotide sequence (SEQ ID NO:1) of a native sequence PRO213 cDNA, wherein SEQ ID NO:1 is a clone designated herein as "UNQ187" and/or "DNA30943-1163".

FIG. 2 shows the amino acid sequence (SEQ ID NO:2) derived from the coding sequence of SEQ ID NO:1 shown in FIG. 1.

FIG. 3 shows a nucleotide sequence (SEQ ID NO:6) of a native sequence PRO274 cDNA, wherein SEQ ID NO:6 is a clone designated herein as "UNQ241" and/or "DNA39987-1184".

FIG. 4 shows the amino acid sequence (SEQ ID NO:7) derived from the coding sequence of SEQ ID NO:6 shown in FIG. 3.

FIG. 5 shows an EST nucleotide sequence designated herein as DNA17873 (SEQ ID NO:8).

FIG. 6 shows an EST nucleotide sequence designated herein as DNA36157 (SEQ ID NO:9).

FIG. 7 shows an EST nucleotide sequence designated herein as DNA28929 (SEQ ID NO:10).

FIG. 8 shows a nucleotide sequence (SEQ ID NO:18) of a native sequence PRO300 cDNA, wherein SEQ ID NO:18 is a clone designated herein as "UNQ263" and/or "DNA40625-1189".

FIG. 9 shows the amino acid sequence (SEQ ID NO:19) derived from the coding sequence of SEQ ID NO:18 shown in FIG. 8.

FIG. 10 shows a nucleotide sequence (SEQ ID NO:27) of a native sequence PRO284 cDNA, wherein SEQ ID NO:27 is a clone designated herein as "UNQ247" and/or "DNA23318-1211".

FIG. 11 shows the amino acid sequence (SEQ ID NO:28) derived from the coding sequence of SEQ ID NO:27 shown in FIG. 10.

FIG. 12 shows an EST nucleotide sequence designated herein as DNA12982 (SEQ ID NO:29).

FIG. 13 shows an EST nucleotide sequence designated herein as DNA15886 (SEQ ID NO:30).

FIG. 14 shows a nucleotide sequence (SEQ ID NO:35) of a native sequence PRO296 cDNA, wherein SEQ ID NO:35 is a clone designated herein as "UNQ260" and/or "DNA39979-1213".

FIG. 15 shows the amino acid sequence (SEQ ID NO:36) derived from the coding sequence of SEQ ID NO:35 shown in FIG. 14.

FIG. 16 shows an EST nucleotide sequence designated herein as DNA23020 (SEQ ID NO:37).

FIG. 17 shows an EST nucleotide sequence designated herein as DNA21971 (SEQ ID NO:38).

FIG. 18 shows an EST nucleotide sequence designated herein as DNA29037 (SEQ ID NO:39).

FIG. 19 shows a nucleotide sequence (SEQ ID NO:44) of a native sequence PRO329 cDNA, wherein SEQ ID NO:44 is a clone designated herein as "UNQ291" and/or "DNA40594-1233".

FIG. 20 shows the amino acid sequence (SEQ ID NO:45) derived from the coding sequence of SEQ ID NO:44 shown in FIG. 19.

FIG. 21 shows a nucleotide sequence (SEQ ID NO:51) of a native sequence PRO362 cDNA, wherein SEQ ID NO:51 is a clone designated herein as "UNQ317" and/or "DNA45416-1251".

FIG. 22 shows the amino acid sequence (SEQ ID NO:52) derived from the coding sequence of SEQ ID NO:51 shown in FIG. 21.

FIG. 23 shows a nucleotide sequence (SEQ ID NO:58) of a native sequence PRO363 cDNA, wherein SEQ ID NO:58 is a clone designated herein as "UNQ318" and/or "DNA45419-1252".

FIG. 24 shows the amino acid sequence (SEQ ID NO:59) derived from the coding sequence of SEQ ID NO:58 shown in FIG. 23.

FIG. 25 shows a nucleotide sequence (SEQ ID NO:63) of a native sequence PRO868 cDNA, wherein SEQ ID NO:63 is a clone designated herein as "UNQ437" and/or "DNA52594-1270".

FIG. 26 shows the amino acid sequence (SEQ ID NO:64) derived from the coding sequence of SEQ ID NO:63 shown in FIG. 25.

FIG. 27 shows a nucleotide sequence (SEQ ID NO:68) of a native sequence PRO382 cDNA, wherein SEQ ID NO:68 is a clone designated herein as "UNQ323" and/or "DNA45234-1277".

FIG. 28 shows the amino acid sequence (SEQ ID NO:69) derived from the coding sequence of SEQ ID NO:68 shown in FIG. 27.

FIG. 29 shows a nucleotide sequence (SEQ ID NO:73) of a native sequence PRO545 cDNA, wherein SEQ ID NO:73 is a clone designated herein as "UNQ346" and/or "DNA49624-1279".

FIG. 30 shows the amino acid sequence (SEQ ID NO:74) derived from the coding sequence of SEQ ID NO:73 shown in FIG. 29.

FIG. 31 shows an EST nucleotide sequence designated herein as DNA13217 (SEQ ID NO:75).

FIG. 32 shows a nucleotide sequence (SEQ ID NO:84) of a native sequence PRO617 cDNA, wherein SEQ ID NO:84 is a clone designated herein as "UNQ353" and/or "DNA48309-1280".

FIG. 33 shows the amino acid sequence (SEQ ID NO:85) derived from the coding sequence of SEQ ID NO:84 shown in FIG. 32.

FIG. 34 shows a nucleotide sequence (SEQ ID NO:89) of a native sequence PRO700 cDNA, wherein SEQ ID NO:89 is a clone designated herein as "UNQ364" and/or "DNA46776-1284".

FIG. 35 shows the amino acid sequence (SEQ ID NO:90) derived from the coding sequence of SEQ ID NO:89 shown in FIG. 34.

FIG. 36 shows a nucleotide sequence (SEQ ID NO:96) of a native sequence PRO702 cDNA, wherein SEQ ID NO:96 is a clone designated herein as "UNQ366" and/or "DNA50980-1286".

FIG. 37 shows the amino acid sequence (SEQ ID NO:97) derived from the coding sequence of SEQ ID NO:96 shown in FIG. 36.

FIG. 38 shows a nucleotide sequence (SEQ ID NO:101) of a native sequence PRO703 cDNA, wherein SEQ ID NO:101 is a clone designated herein as "UNQ367" and/or "DNA50913-1287".

FIG. 39 shows the amino acid sequence (SEQ ID NO:102) derived from the coding sequence of SEQ ID NO:101 shown in FIG. 38.

FIG. 40 shows a nucleotide sequence (SEQ ID NO:108) of a native sequence PRO705 cDNA, wherein SEQ ID NO:108 is a clone designated herein as "UNQ369" and/or "DNA50914-1289".

FIG. 41 shows the amino acid sequence (SEQ ID NO:109) derived from the coding sequence of SEQ ID NO:108 shown in FIG. 40.

FIGS. 42A–B show a nucleotide sequence (SEQ ID NO:113) of a native sequence PRO708 cDNA, wherein SEQ ID NO:113 is a clone designated herein as "UNQ372" and/or "DNA48296-1292".

FIG. 43 shows the amino acid sequence (SEQ ID NO:114) derived from the coding sequence of SEQ ID NO:113 shown in FIGS. 42A–B.

FIG. 44 shows a nucleotide sequence (SEQ ID NO:118) of a native sequence PRO320 cDNA, wherein SEQ ID NO:118 is a clone designated herein as "UNQ281" and/or "DNA32284-1307".

FIG. 45 shows the amino acid sequence (SEQ ID NO:119) derived from the coding sequence of SEQ ID NO:118 shown in FIG. 44.

FIG. 46 shows a nucleotide sequence (SEQ ID NO:123) of a native sequence PRO324 cDNA, wherein SEQ ID NO:123 is a clone designated herein as "UNQ285" and/or "DNA36343-1310".

FIG. 47 shows the amino acid sequence (SEQ ID NO:124) derived from the coding sequence of SEQ ID NO:123 shown in FIG. 46.

FIG. 48 shows a nucleotide sequence (SEQ ID NO:131) of a native sequence PRO351 cDNA, wherein SEQ ID NO:131 is a clone designated herein as "UNQ308" and/or "DNA40571-1315".

FIG. 49 shows the amino acid sequence (SEQ ID NO:132) derived from the coding sequence of SEQ ID NO:131 shown in FIG. 48.

FIG. 50 shows a nucleotide sequence (SEQ ID NO:136) of a native sequence PRO352 cDNA, wherein SEQ ID NO:136 is a clone designated herein as "UNQ309" and/or "DNA41386-1316".

FIG. 51 shows the amino acid sequence (SEQ ID NO:137) derived from the coding sequence of SEQ ID NO:136 shown in FIG. 50.

FIG. 52 shows a nucleotide sequence (SEQ ID NO:144) of a native sequence PRO381 cDNA, wherein SEQ ID NO:144 is a clone designated herein as "UNQ322" and/or "DNA44194-1317".

FIG. 53 shows the amino acid sequence (SEQ ID NO:145) derived from the coding sequence of SEQ ID NO:144 shown in FIG. 52.

FIG. 54 shows a nucleotide sequence (SEQ ID NO:149) of a native sequence PRO386 cDNA, wherein SEQ ID NO:149 is a clone designated herein as "UNQ326" and/or "DNA45415-1318".

FIG. 55 shows the amino acid sequence (SEQ ID NO:150) derived from the coding sequence of SEQ ID NO:149 shown in FIG. 54.

FIG. 56 shows an EST nucleotide sequence designated herein as DNA23350 (SEQ ID NO:151).

FIG. 57 shows an EST nucleotide sequence designated herein as DNA23536 (SEQ ID NO:152).

FIG. 58 shows a nucleotide sequence (SEQ ID NO:156) of a native sequence PRO540 cDNA, wherein SEQ ID NO:156 is a clone designated herein as "UNQ341" and/or "DNA44189-1322".

FIG. 59 shows the amino acid sequence (SEQ ID NO:157) derived from the coding sequence of SEQ ID NO:156 shown in FIG. 58.

FIG. 60 shows a nucleotide sequence (SEQ ID NO:161) of a native sequence PRO615 cDNA, wherein SEQ ID NO:161 is a clone designated herein as "UNQ352" and/or "DNA48304-1323".

FIG. 61 shows the amino acid sequence (SEQ ID NO:162) derived from the coding sequence of SEQ ID NO:161 shown in FIG. 60.

FIG. 62 shows a nucleotide sequence (SEQ ID NO:168) of a native sequence PRO618 cDNA, wherein SEQ ID NO:168 is a clone designated herein as "UNQ354" and/or "DNA49152-1324".

FIG. 63 shows the amino acid sequence (SEQ ID NO:169) derived from the coding sequence of SEQ ID NO:168 shown in FIG. 62.

FIG. 64 shows an EST nucleotide sequence designated herein as DNA35597 (SEQ ID NO:170).

FIG. 65 shows a nucleotide sequence (SEQ ID NO:177) of a native sequence PRO719 cDNA, wherein SEQ ID NO:177 is a clone designated herein as "UNQ387" and/or "DNA49646-1327".

FIG. 66 shows the amino acid sequence (SEQ ID NO:178) derived from the coding sequence of SEQ ID NO:177 shown in FIG. 65.

FIG. 67 shows a nucleotide sequence (SEQ ID NO:182) of a native sequence PRO724 cDNA, wherein SEQ ID NO:182 is a clone designated herein as "UNQ389" and/or "DNA49631-1328".

FIG. 68 shows the amino acid sequence (SEQ ID NO:183) derived from the coding sequence of SEQ ID NO:182 shown in FIG. 67.

FIG. 69 shows a nucleotide sequence (SEQ ID NO:189) of a native sequence PRO772 cDNA, wherein SEQ ID NO:189 is a clone designated herein as "UNQ410" and/or "DNA49645-1347".

FIG. 70 shows the amino acid sequence (SEQ ID NO:190) derived from the coding sequence of SEQ ID NO:189 shown in FIG. 69.

FIG. 71 shows an EST nucleotide sequence designated herein as DNA43509 (SEQ ID NO:191).

FIG. 72 shows a nucleotide sequence (SEQ ID NO:195) of a native sequence PRO852 cDNA, wherein SEQ ID NO:195 is a clone designated herein as "UNQ418" and/or "DNA45493-1349".

FIG. 73 shows the amino acid sequence (SEQ ID NO:196) derived from the coding sequence of SEQ ID NO:195 shown in FIG. 72.

FIG. 74 shows a nucleotide sequence (SEQ ID NO:205) of a native sequence PRO853 cDNA, wherein SEQ ID NO:205 is a clone designated herein as "UNQ419" and/or "DNA48227-1350".

FIG. 75 shows the amino acid sequence (SEQ ID NO:206) derived from the coding sequence of SEQ ID NO:205 shown in FIG. 74.

FIG. 76 shows a nucleotide sequence (SEQ ID NO:210) of a native sequence PRO860 cDNA, wherein SEQ ID NO:210 is a clone designated herein as "UNQ421" and/or "DNA41404-1352".

FIG. 77 shows the amino acid sequence (SEQ ID NO:211) derived from the coding sequence of SEQ ID NO:210 shown in FIG. 76.

FIG. 78 shows a nucleotide sequence (SEQ ID NO:215) of a native sequence PRO846 cDNA, wherein SEQ ID NO:215 is a clone designated herein as "UNQ422" and/or "DNA44196-1353".

FIG. 79 shows the amino acid sequence (SEQ ID NO:216) derived from the coding sequence of SEQ ID NO:215 shown in FIG. 78.

FIG. 80 shows a nucleotide sequence (SEQ ID NO:220) of a native sequence PRO862 cDNA, wherein SEQ ID NO:220 is a clone designated herein as "UNQ424" and/or "DNA52187-1354".

FIG. 81 shows the amino acid sequence (SEQ ID NO:221) derived from the coding sequence of SEQ ID NO:220 shown in FIG. 80.

FIG. 82 shows a nucleotide sequence (SEQ ID NO:225) of a native sequence PRO864 cDNA, wherein SEQ ID NO:225 is a clone designated herein as "UNQ426" and/or "DNA48328-1355".

FIG. 83 shows the amino acid sequence (SEQ ID NO:226) derived from the coding sequence of SEQ ID NO:225 shown in FIG. 82.

FIG. 84 shows a nucleotide sequence (SEQ ID NO:230) of a native sequence PRO792 cDNA, wherein SEQ ID NO:230 is a clone designated herein as "UNQ431" and/or "DNA56352-1358".

FIG. 85 shows the amino acid sequence (SEQ ID NO:231) derived from the coding sequence of SEQ ID NO:230 shown in FIG. 84.

FIG. 86 shows a nucleotide sequence (SEQ ID NO:235) of a native sequence PRO866 cDNA, wherein SEQ ID NO:235 is a clone designated herein as "UNQ435" and/or "DNA53971-1359".

FIG. 87 shows the amino acid sequence (SEQ ID NO:236) derived from the coding sequence of SEQ ID NO:235 shown in FIG. 86.

FIG. 88 shows a nucleotide sequence (SEQ ID NO:244) of a native sequence PRO871 cDNA, wherein SEQ ID NO:244 is a clone designated herein as "UNQ438" and/or "DNA50919-1361".

FIG. 89 shows the amino acid sequence (SEQ ID NO:245) derived from the coding sequence of SEQ ID NO:244 shown in FIG. 88.

FIG. 90 shows a nucleotide sequence (SEQ ID NO:253) of a native sequence PRO873 cDNA, wherein SEQ ID NO:253 is a clone designated herein as "UNQ440" and/or "DNA44179-1362".

FIG. 91 shows the amino acid sequence (SEQ ID NO:254) derived from the coding sequence of SEQ ID NO:253 shown in FIG. 90.

FIG. 92 shows a nucleotide sequence (SEQ ID NO:258) of a native sequence PRO940 cDNA, wherein SEQ ID NO:258 is a clone designated herein as "UNQ477" and/or "DNA54002-1367".

FIG. 93 shows the amino acid sequence (SEQ ID NO:259) derived from the coding sequence of SEQ ID NO:258 shown in FIG. 92.

FIG. 94 shows a nucleotide sequence (SEQ ID NO:263) of a native sequence PRO941 cDNA, wherein SEQ ID NO:263 is a clone designated herein as "UNQ478" and/or "DNA53906-1368".

FIG. 95 shows the amino acid sequence (SEQ ID NO:264) derived from the coding sequence of SEQ ID NO:263 shown in FIG. 94.

FIG. 96 shows an EST nucleotide sequence designated herein as DNA6415 (SEQ ID NO:265).

FIG. 97 shows a nucleotide sequence (SEQ ID NO:269) of a native sequence PRO944 cDNA, wherein SEQ ID NO:269 is a clone designated herein as "UNQ481" and/or "DNA52185-1370".

FIG. 98 shows the amino acid sequence (SEQ ID NO:270) derived from the coding sequence of SEQ ID NO:269 shown in FIG. 97.

FIG. 99 shows an EST nucleotide sequence designated herein as DNA14007 (SEQ ID NO:271).

FIG. 100 shows an EST nucleotide sequence designated herein as DNA12773 (SEQ ID NO:272).

FIG. 101 shows an EST nucleotide sequence designated herein as DNA12746 (SEQ ID NO:273).

FIG. 102 shows an EST nucleotide sequence designated herein as DNA12834 (SEQ ID NO:274).

FIG. 103 shows an EST nucleotide sequence designated herein as DNA12846 (SEQ ID NO:275).

FIG. 104 shows an EST nucleotide sequence designated herein as DNA13104 (SEQ ID NO:276).

FIG. 105 shows an EST nucleotide sequence designated herein as DNA13259 (SEQ ID NO:277).

FIG. 106 shows an EST nucleotide sequence designated herein as DNA13959 (SEQ ID NO:278).

FIG. 107 shows an EST nucleotide sequence designated herein as DNA13961 (SEQ ID NO:279).

FIG. 108 shows a nucleotide sequence (SEQ ID NO:283) of a native sequence PRO983 cDNA, wherein SEQ ID NO:283 is a clone designated herein as "UNQ484" and/or "DNA53977-1371".

FIG. 109 shows the amino acid sequence (SEQ ID NO:284) derived from the coding sequence of SEQ ID NO:283 shown in FIG. 108.

FIG. 110 shows an EST nucleotide sequence designated herein as DNA17130 (SEQ ID NO:285).

FIG. 111 shows an EST nucleotide sequence designated herein as DNA23466 (SEQ ID NO:286).

FIG. 112 shows an EST nucleotide sequence designated herein as DNA26818 (SEQ ID NO:287).

FIG. 113 shows an EST nucleotide sequence designated herein as DNA37618 (SEQ ID NO:288).

FIG. 114 shows an EST nucleotide sequence designated herein as DNA41732 (SEQ ID NO:289).

FIG. 115 shows an EST nucleotide sequence designated herein as DNA45980 (SEQ ID NO:290).

FIG. 116 shows an EST nucleotide sequence designated herein as DNA46372 (SEQ ID NO:291).

FIG. 117 shows a nucleotide sequence (SEQ ID NO:295) of a native sequence PRO1057 cDNA, wherein SEQ ID NO:295 is a clone designated herein as "UNQ522" and/or "DNA57253-1382".

FIG. 118 shows the amino acid sequence (SEQ ID NO:296) derived from the coding sequence of SEQ ID NO:295 shown in FIG. 117.

FIG. 119 shows a nucleotide sequence (SEQ ID NO:300) of a native sequence PRO1071 cDNA, wherein SEQ ID NO:300 is a clone designated herein as "UNQ528" and/or "DNA58847-1383".

FIG. 120 shows the amino acid sequence (SEQ ID NO:301) derived from the coding sequence of SEQ ID NO:300 shown in FIG. 119.

FIG. 121 shows a nucleotide sequence (SEQ ID NO:302) of a native sequence PRO1072 cDNA, wherein SEQ ID NO:302 is a clone designated herein as "UNQ529" and/or "DNA58747-1384".

FIG. 122 shows the amino acid sequence (SEQ ID NO:303) derived from the coding sequence of SEQ ID NO:302 shown in FIG. 121.

FIG. 123 shows an EST nucleotide sequence designated herein as DNA40210 (SEQ ID NO:304).

FIG. 124 shows a nucleotide sequence (SEQ ID NO:308) of a native sequence PRO1075 cDNA, wherein SEQ ID NO:308 is a clone designated herein as "UNQ532" and/or "DNA57689-1385".

FIG. 125 shows the amino acid sequence (SEQ ID NO:309) derived from the coding sequence of SEQ ID NO:308 shown in FIG. 124.

FIG. 126 shows an EST nucleotide sequence designated herein as DNA13059 (SEQ ID NO:310).

FIG. 127 shows an EST nucleotide sequence designated herein as DNA19463 (SEQ ID NO:311).

FIG. 128 shows a nucleotide sequence (SEQ ID NO:321) of a native sequence PRO181 cDNA, wherein SEQ ID NO:321 is a clone designated herein as "UNQ155" and/or "DNA23330-1390".

FIG. 129 shows the amino acid sequence (SEQ ID NO:322) derived from the coding sequence of SEQ ID NO:321 shown in FIG. 128.

FIG. 130 shows an EST nucleotide sequence designated herein as DNA13242 (SEQ ID NO:323).

FIG. 131 shows a nucleotide sequence (SEQ ID NO:329) of a native sequence PRO195 cDNA, wherein SEQ ID NO:329 is a clone designated herein as "UNQ169" and/or "DNA26847-1395".

FIG. 132 shows the amino acid sequence (SEQ ID NO:330) derived from the coding sequence of SEQ ID NO:329 shown in FIG. 131.

FIG. 133 shows an EST nucleotide sequence designated herein as DNA15062 (SEQ ID NO:331).

FIG. 134 shows an EST nucleotide sequence designated herein as DNA13199 (SEQ ID NO:332).

FIG. 135 shows a nucleotide sequence (SEQ ID NO:336) of a native sequence PRO865 cDNA, wherein SEQ ID NO:336 is a clone designated herein as "UNQ434" and/or "DNA53974-1401".

FIG. 136 shows the amino acid sequence (SEQ ID NO:337) derived from the coding sequence of SEQ ID NO:336 shown in FIG. 135.

FIG. 137 shows an EST nucleotide sequence designated herein as DNA37642 (SEQ ID NO:338).

FIG. 138 shows a nucleotide sequence (SEQ ID NO:345) of a native sequence PRO827 cDNA, wherein SEQ ID NO:345 is a clone designated herein as "UNQ468" and/or "DNA57039-1402".

FIG. 139 shows the amino acid sequence (SEQ ID NO:346) derived from the coding sequence of SEQ ID NO:345 shown in FIG. 138.

FIG. 140 shows an EST nucleotide sequence designated herein as DNA47751 (SEQ ID NO:347).

FIG. 141 shows a nucleotide sequence (SEQ ID NO:351) of a native sequence PRO1114 cDNA, wherein SEQ ID NO:351 is a clone designated herein as "UNQ557" and/or "DNA57033-1403".

FIG. 142 shows the amino acid sequence (SEQ ID NO:352) derived from the coding sequence of SEQ ID NO:351 shown in FIG. 141.

FIG. 143 shows an EST nucleotide sequence designated herein as DNA48466 (SEQ ID NO:353).

FIG. 144 shows a nucleotide sequence (SEQ ID NO:357) of a native sequence PRO237 cDNA, wherein SEQ ID NO:357 is a clone designated herein as "UNQ211" and/or "DNA34353-1428".

FIG. 145 shows the amino acid sequence (SEQ ID NO:358) derived from the coding sequence of SEQ ID NO:357 shown in FIG. 144.

FIG. 146 shows a nucleotide sequence (SEQ ID NO:362) of a native sequence PRO541 cDNA, wherein SEQ ID NO:362 is a clone designated herein as "UNQ342" and/or "DNA45417-1432".

FIG. 147 shows the amino acid sequence (SEQ ID NO:363) derived from the coding sequence of SEQ ID NO:362 shown in FIG. 146.

FIG. 148 shows a nucleotide sequence (SEQ ID NO:369) of a native sequence PRO273 cDNA, wherein SEQ ID NO:369 is a clone designated herein as "UNQ240" and/or "DNA39523-1192".

FIG. 149 shows the amino acid sequence (SEQ ID NO:370) derived from the coding sequence of SEQ ID NO:369 shown in FIG. 148.

FIG. 150 shows a nucleotide sequence (SEQ ID NO:374) of a native sequence PRO701 cDNA, wherein SEQ ID NO:374 is a clone designated herein as "UNQ365" and/or "DNA44205-1285".

FIG. 151 shows the amino acid sequence (SEQ ID NO:375) derived from the coding sequence of SEQ ID NO:374 shown in FIG. 150.

FIG. 152 shows a nucleotide sequence (SEQ ID NO:379) of a native sequence PRO704 cDNA, wherein SEQ ID NO:379 is a clone designated herein as "UNQ368" and/or "DNA50911-1288".

FIG. 153 shows the amino acid sequence (SEQ ID NO:380) derived from the coding sequence of SEQ ID NO:379 shown in FIG. 152.

FIG. 154 shows a nucleotide sequence (SEQ ID NO:384) of a native sequence PRO706 cDNA, wherein SEQ ID NO:384 is a clone designated herein as "UNQ370" and/or "DNA48329-1290".

FIG. 155 shows the amino acid sequence (SEQ ID NO:385) derived from the coding sequence of SEQ ID NO:384 shown in FIG. 154.

FIG. 156 shows a nucleotide sequence (SEQ ID NO:389) of a native sequence PRO707 cDNA, wherein SEQ ID NO:389 is a clone designated herein as "UNQ371" and/or "DNA48306-1291".

FIG. 157 shows the amino acid sequence (SEQ ID NO:390) derived from the coding sequence of SEQ ID NO:389 shown in FIG. 156.

FIG. 158 shows a nucleotide sequence (SEQ ID NO:394) of a native sequence PRO322 cDNA, wherein SEQ ID NO:394 is a clone designated herein as "UNQ283" and/or "DNA48336-1309".

FIG. 159 shows the amino acid sequence (SEQ ID NO:395) derived from the coding sequence of SEQ ID NO:394 shown in FIG. 158.

FIG. 160 shows a nucleotide sequence (SEQ ID NO:399) of a native sequence PRO526 cDNA, wherein SEQ ID NO:399 is a clone designated herein as "UNQ330" and/or "DNA44184-1319".

FIG. 161 shows the amino acid sequence (SEQ ID NO:400) derived from the coding sequence of SEQ ID NO:399 shown in FIG. 160.

FIG. 162 shows a nucleotide sequence (SEQ ID NO:404) of a native sequence PRO531 cDNA, wherein SEQ ID NO:404 is a clone designated herein as "UNQ332" and/or "DNA48314-1320".

FIG. 163 shows the amino acid sequence (SEQ ID NO:405) derived from the coding sequence of SEQ ID NO:404 shown in FIG. 162.

FIG. 164 shows a nucleotide sequence (SEQ ID NO:409) of a native sequence PRO534 cDNA, wherein SEQ ID NO:409 is a clone designated herein as "UNQ335" and/or "DNA48333-1321".

FIG. 165 shows the amino acid sequence (SEQ ID NO:410) derived from the coding sequence of SEQ ID NO:409 shown in FIG. 164.

FIG. 166 shows a nucleotide sequence (SEQ ID NO:414) of a native sequence PRO697 cDNA, wherein SEQ ID NO:414 is a clone designated herein as "UNQ361" and/or "DNA50920-1325".

FIG. 167 shows the amino acid sequence (SEQ ID NO:415) derived from the coding sequence of SEQ ID NO:414 shown in FIG. 166.

FIG. 168 shows a nucleotide sequence (SEQ ID NO:419) of a native sequence PRO717 cDNA, wherein SEQ ID NO:419 is a clone designated herein as "UNQ385" and/or "DNA50988-1326".

FIG. 169 shows the amino acid sequence (SEQ ID NO:420) derived from the coding sequence of SEQ ID NO:419 shown in FIG. 168.

FIG. 170 shows a nucleotide sequence (SEQ ID NO:424) of a native sequence PRO731 cDNA, wherein SEQ ID NO:424 is a clone designated herein as "UNQ395" and/or "DNA48331-1329".

FIG. 171 shows the amino acid sequence (SEQ ID NO:425) derived from the coding sequence of SEQ ID NO:424 shown in FIG. 170.

FIG. 172 shows a nucleotide sequence (SEQ ID NO:429) of a native sequence PRO218 cDNA, wherein SEQ ID NO:429 is a clone designated herein as "UNQ192" and/or "DNA30867-1335".

FIG. 173 shows the amino acid sequence (SEQ ID NO:430) derived from the coding sequence of SEQ ID NO:429 shown in FIG. 172.

FIG. 174 shows an EST nucleotide sequence designated herein as DNA14472 (SEQ ID NO:431).

FIG. 175 shows an EST nucleotide sequence designated herein as DNA15846 (SEQ ID NO:432).

FIG. 176 shows a nucleotide sequence (SEQ ID NO:436) of a native sequence PRO768 cDNA, wherein SEQ ID NO:436 is a clone designated herein as "UNQ406" and/or "DNA55737-1345".

FIG. 177 shows the amino acid sequence (SEQ ID NO:437) derived from the coding sequence of SEQ ID NO:436 shown in FIG. 176.

FIG. 178 shows a nucleotide sequence (SEQ ID NO:441) of a native sequence PRO771 cDNA, wherein SEQ ID NO:441 is a clone designated herein as "UNQ409" and/or "DNA49829-1346".

FIG. 179 shows the amino acid sequence (SEQ ID NO:442) derived from the coding sequence of SEQ ID NO:441 shown in FIG. 178.

FIG. 180 shows a nucleotide sequence (SEQ ID NO:446) of a native sequence PRO733 cDNA, wherein SEQ ID NO:446 is a clone designated herein as "UNQ411" and/or "DNA52196-1348".

FIG. 181 shows the amino acid sequence (SEQ ID NO:447) derived from the coding sequence of SEQ ID NO:446 shown in FIG. 180.

FIG. 182 shows a nucleotide sequence (SEQ ID NO:451) of a native sequence PRO162 cDNA, wherein SEQ ID NO:451 is a clone designated herein as "UNQ429" and/or "DNA56965-1356".

FIG. 183 shows the amino acid sequence (SEQ ID NO:452) derived from the coding sequence of SEQ ID NO:451 shown in FIG. 182.

FIG. 184 shows a nucleotide sequence (SEQ ID NO:453) of a native sequence PRO788 cDNA, wherein SEQ ID NO:453 is a clone designated herein as "UNQ430" and/or "DNA56405-1357".

FIG. 185 shows the amino acid sequence (SEQ ID NO:454) derived from the coding sequence of SEQ ID NO:453 shown in FIG. 184.

FIG. 186 shows a nucleotide sequence (SEQ ID NO:455) of a native sequence PRO1008 cDNA, wherein SEQ ID NO:455 is a clone designated herein as "UNQ492" and/or "DNA57530-1375".

FIG. 187 shows the amino acid sequence (SEQ ID NO:456) derived from the coding sequence of SEQ ID NO:455 shown in FIG. 186.

FIG. 188 shows an EST nucleotide sequence designated herein as DNA16508 (SEQ ID NO:457).

FIG. 189 shows a nucleotide sequence (SEQ ID NO:458) of a native sequence PRO1012 cDNA, wherein SEQ ID NO:458 is a clone designated herein as "UNQ495" and/or "DNA56439-1376".

FIG. 190 shows the amino acid sequence (SEQ ID NO:459) derived from the coding sequence of SEQ ID NO:458 shown in FIG. 189.

FIG. 191 shows a nucleotide sequence (SEQ ID NO:463) of a native sequence PRO1014 cDNA, wherein SEQ ID NO:463 is a clone designated herein as "UNQ497" and/or "DNA56409-1377".

FIG. 192 shows the amino acid sequence (SEQ ID NO:464) derived from the coding sequence of SEQ ID NO:463 shown in FIG. 191.

FIG. 193 shows a nucleotide sequence (SEQ ID NO:465) of a native sequence PRO1017 cDNA, wherein SEQ ID NO:465 is a clone designated herein as "UNQ500" and/or "DNA56112-1379".

FIG. 194 shows the amino acid sequence (SEQ ID NO:466) derived from the coding sequence of SEQ ID NO:465 shown in FIG. 193.

FIG. 195 shows a nucleotide sequence (SEQ ID NO:467) of a native sequence PRO474 cDNA, wherein SEQ ID NO:467 is a clone designated herein as "UNQ502" and/or "DNA56045-1380".

FIG. 196 shows the amino acid sequence (SEQ ID NO:468) derived from the coding sequence of SEQ ID NO:467 shown in FIG. 195.

FIG. 197 shows a nucleotide sequence (SEQ ID NO:469) of a native sequence PRO1031 cDNA, wherein SEQ ID NO:469 is a clone designated herein as "UNQ516" and/or "DNA59294-1381".

FIG. 198 shows the amino acid sequence (SEQ ID NO:470) derived from the coding sequence of SEQ ID NO:469 shown in FIG. 197.

FIG. 199 shows a nucleotide sequence (SEQ ID NO:471) of a native sequence PRO938 cDNA, wherein SEQ ID NO:471 is a clone designated herein as "UNQ475" and/or "DNA56433-1406".

FIG. 200 shows the amino acid sequence (SEQ ID NO:472) derived from the coding sequence of SEQ ID NO:471 shown in FIG. 199.

FIG. 201 shows a nucleotide sequence (SEQ ID NO:476) of a native sequence PRO1082 cDNA, wherein SEQ ID NO:476 is a clone designated herein as "UNQ539" and/or "DNA53912-1457".

FIG. 202 shows the amino acid sequence (SEQ ID NO:477) derived from the coding sequence of SEQ ID NO:476 shown in FIG. 201.

FIG. 203 shows a nucleotide sequence (SEQ ID NO:482) of a native sequence PRO1083 cDNA, wherein SEQ ID NO:482 is a clone designated herein as "UNQ540" and/or "DNA50921-1458".

FIG. 204 shows the amino acid sequence (SEQ ID NO:483) derived from the coding sequence of SEQ ID NO:482 shown in FIG. 203.

FIG. 205 shows an EST nucleotide sequence designated herein as DNA24256 (SEQ ID NO:484).

FIG. 206 shows a nucleotide sequence (SEQ ID NO:487) of a native sequence PRO200 cDNA, wherein SEQ ID NO:487 is a clone designated herein as "UNQ174" and/or "DNA29101-1122".

FIG. 207 shows the amino acid sequence (SEQ ID NO:488) derived from the coding sequence of SEQ ID NO:487 shown in FIG. 206.

FIG. 208 shows a nucleotide sequence (SEQ ID NO:495) of a native sequence PRO285 cDNA, wherein SEQ ID NO:495 is a clone designated herein as "DNA40021-1154".

FIG. 209 shows the amino acid sequence (SEQ ID NO:496) derived from the coding sequence of SEQ ID NO:495 shown in FIG. 208.

FIG. 210 shows a nucleotide sequence (SEQ ID NO:497) of a native sequence PRO286 cDNA, wherein SEQ ID NO:497 is a clone designated herein as "DNA42663-1154".

FIG. 211 shows the amino acid sequence (SEQ ID NO:498) derived from the coding sequence of SEQ ID NO:497 shown in FIG. 210.

FIG. 212 shows a nucleotide sequence (SEQ ID NO:505) of a native sequence PRO213-1 cDNA, wherein SEQ ID NO:505 is a clone designated herein as "DNA30943-1-1163-1".

FIG. 213 shows the amino acid sequence (SEQ ID NO:506) derived from the coding sequence of SEQ ID NO:505 shown in FIG. 212.

FIG. 214 shows a nucleotide sequence (SEQ ID NO:507) of a native sequence PRO1330 cDNA, wherein SEQ ID NO:507 is a clone designated herein as "DNA64907-1163-1".

FIG. 215 shows the amino acid sequence (SEQ ID NO:508) derived from the coding sequence of SEQ ID NO:507 shown in FIG. 214.

FIG. 216 shows a nucleotide sequence (SEQ ID NO:509) of a native sequence PRO1449 cDNA, wherein SEQ ID NO:509 is a clone designated herein as "DNA64908-1163-1".

FIG. 217 shows the amino acid sequence (SEQ ID NO:510) derived from the coding sequence of SEQ ID NO:509 shown in FIG. 216.

FIG. 218 shows a nucleotide sequence (SEQ ID NO:514) of a native sequence PRO298 cDNA, wherein SEQ ID NO:514 is a clone designated herein as "UNQ261" and/or "DNA39975-1210".

FIG. 219 shows the amino acid sequence (SEQ ID NO:515) derived from the coding sequence of SEQ ID NO:514 shown in FIG. 218.

FIG. 220 shows an EST nucleotide sequence designated herein as DNA26832 (SEQ ID NO:516).

FIG. 221 shows a nucleotide sequence (SEQ ID NO:522) of a native sequence PRO337 cDNA, wherein SEQ ID NO:522 is a clone designated herein as "DNA43316-1237".

FIG. 222 shows the amino acid sequence (SEQ ID NO:523) derived from the coding sequence of SEQ ID NO:522 shown in FIG. 221.

FIG. 223 shows an EST nucleotide sequence designated herein as DNA42301 (SEQ ID NO:524).

FIG. 224 shows a nucleotide sequence (SEQ ID NO:525) of a native sequence PRO403 cDNA, wherein SEQ ID NO:525 is a clone designated herein as "DNA55800-1263".

FIG. 225 shows the amino acid sequence (SEQ ID NO:526) derived from the coding sequence of SEQ ID NO:525 shown in FIG. 224.

FIG. 226 shows an EST nucleotide sequence designated herein as DNA34415 (SEQ ID NO:527).

FIG. 227 shows an EST nucleotide sequence designated herein as DNA49830 (SEQ ID NO:528).

FIG. 228 shows an EST nucleotide sequence designated herein as DNA49831 (SEQ ID NO:529).

FIG. 229 shows a nucleotide sequence (SEQ ID NO:611) of a native sequence PRO4993 cDNA, wherein SEQ ID NO:611 is a clone designated herein as "DNA94832-2659".

FIG. 230 shows the amino acid sequence (SEQ ID NO:612) derived from the coding sequence of SEQ ID NO:611 shown in FIG. 229.

FIG. 231 shows a nucleotide sequence (SEQ ID NO:613) of a native sequence PRO1559 cDNA, wherein SEQ ID NO:613 is a clone designated herein as "DNA68886".

FIG. 232 shows the amino acid sequence (SEQ ID NO:614) derived from the coding sequence of SEQ ID NO:613 shown in FIG. 231.

FIG. 233 shows a nucleotide sequence (SEQ ID NO:615) of a native sequence PRO725 cDNA, wherein SEQ ID NO:615 is a clone designated herein as "DNA52758-1399".

FIG. 234 shows the amino acid sequence (SEQ ID NO:616) derived from the coding sequence of SEQ ID NO:615 shown in FIG. 233.

FIG. 235 shows a nucleotide sequence (SEQ ID NO:617) of a native sequence PRO739 cDNA, wherein SEQ ID NO:617 is a clone designated herein as "DNA52756".

FIG. 236 shows the amino acid sequence (SEQ ID NO:618) derived from the coding sequence of SEQ ID NO:617 shown in FIG. 235.

DETAILED DESCRIPTION OF THE PREFERRED EMBODIMENTS

I. Definitions

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety of sources, such as from human tissue types or from another source, or prepared by recombinant or synthetic methods.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extracellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures.

Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are comtemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1–6 (1997) and von Heinje et al., *Nucl. Acids. Res.* 14:4683–4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80% amino acid sequence identity, preferably at least about 81% amino acid sequence identity, more preferably at least about 82% amino acid sequence identity, more preferably at least about 83% amino acid sequence identity, more preferably at least about 84% amino acid sequence identity, more preferably at least about 85% amino acid sequence identity, more preferably at least about 86% amino acid sequence identity, more preferably at least about 87% amino acid sequence identity, more preferably at least about 88% amino acid sequence identity, more preferably at least about 89% amino acid sequence identity, more preferably at least about 90% amino acid sequence identity, more preferably at least about 91% amino acid sequence identity, more preferably at least about 92% amino acid sequence identity, more preferably at least about 93% amino acid sequence identity, more preferably at least about 94% amino acid sequence identity, more preferably at least about 95% amino acid sequence identity, more preferably at least about 96% amino acid sequence identity, more preferably at least about 97% amino acid sequence identity, more preferably at least about 98% amino acid sequence identity and most preferably at least about 99% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10 amino acids in length, often at least about 20 amino acids in length, more often at least about 30 amino acids in length, more often at least about 40 amino acids in length, more often at least about 50 amino acids in length, more often at least about 60 amino acids in length, more often at least about 70 amino acids in length, more often at least about 80 amino acids in length, more often at least about 90 amino acids in length, more often at least about 100 amino acids in length, more often at least about 150 amino acids in length, more often at least about 200 amino acids in length, more often at least about 300 amino acids in length, or more.

"Percent (%) amino acid sequence identity" with respect to the PRO polypeptide sequences identified herein is defined as the percentage of amino acid residues in a candidate sequence that are identical with the amino acid residues in the specific PRO polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Wash. D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "PRO", wherein "PRO" represents the amino acid sequence of a hypothetical PRO polypeptide of interest, "Comparison Protein" represents the amino acid sequence of a polypeptide against which the "PRO" polypeptide of interest is being compared, and "X, "Y" and "Z" each represent different hypothetical amino acid residues.

Unless specifically stated otherwise, all % amino acid sequence identity values used herein are obtained as described in the immediately preceding paragraph using the ALIGN-2 computer program. However, % amino acid sequence identity values may also be obtained as described below by using the WU-BLAST-2 computer program (Altschul et al., *Methods in Enzymology* 266:460–480 (1996)). Most of the WU-BLAST-2 search parameters are set to default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % amino acid sequence identity value is determined by dividing (a) the number of matching identical amino acid residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest. For example, in the statement "a polypeptide comprising an the amino acid sequence A which has or having at least 80% amino acid sequence identity to the amino acid sequence B", the amino acid sequence A is the comparison amino acid sequence of interest and the amino acid sequence B is the amino acid sequence of the PRO polypeptide of interest.

Percent amino acid sequence identity may also be determined using the sequence comparison program NCBI-BLAST2 (Altschul et al., *Nucleic Acids Res.* 25:3389–3402 (1997)). NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

"PRO variant polynucleotide" or "PRO variant nucleic acid sequence" means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80% nucleic acid sequence identity, more preferably at least about 81% nucleic acid sequence identity, more preferably at least about 82% nucleic acid sequence identity, more preferably at least about 83% nucleic acid sequence identity, more preferably at least about 84% nucleic acid sequence identity, more preferably at least about 85% nucleic acid sequence identity, more preferably at least about 86% nucleic acid sequence identity, more preferably at least about 87% nucleic acid sequence identity, more preferably at least about 88% nucleic acid sequence identity, more preferably at least about 89% nucleic acid sequence identity, more preferably at least about 90% nucleic acid sequence identity, more preferably at least about 91% nucleic acid sequence identity, more preferably at least about 92% nucleic acid sequence identity, more preferably at least about 93% nucleic acid sequence identity, more preferably at least about 94% nucleic acid sequence identity, more preferably at least about 95% nucleic acid sequence identity, more preferably at least about 96% nucleic acid sequence identity, more preferably at least about 97% nucleic acid sequence identity, more preferably at least about 98% nucleic acid sequence identity and yet more preferably at least about 99% nucleic acid sequence identity with a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30 nucleotides in length, often at least about 60 nucleotides in length, more often at least about 90 nucleotides in length, more often at least about 120 nucleotides in length, more often at least about 150 nucleotides in length, more often at least about 180 nucleotides in length, more often at least about 210 nucleotides in length, more often at least about 240 nucleotides in length, more often at least about 270 nucleotides in length, more often at least about 300 nucleotides in length, more often at least about 450 nucleotides in length, more often at least about 600 nucleotides in length, more often at least about 900 nucleotides in length, or more.

"Percent (%) nucleic acid sequence identity" with respect to PRO-encoding nucleic acid sequences identified herein is defined as the percentage of nucleotides in a candidate sequence that are identical with the nucleotides in the PRO nucleic acid sequence of interest, after aligning the sequences and introducing gaps, if necessary, to achieve the maxi m num percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program m n ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "PRO-DNA", wherein "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, and "N", "L" and "V" each represent different hypothetical nucleotides.

Unless specifically stated otherwise, all % nucleic acid sequence identity values used herein are obtained as described in the immediately preceding paragraph using the ALIGN-2 computer program. However, % nucleic acid sequence identity values may also be obtained as described below by using the WU-BLAST-2 computer program (Altschul et al., *Methods in Enzymology* 266:460–480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

Percent nucleic acid sequence identity may also be determined using the sequence comparison program NCBI-BLAST2 (Altschul et al., *Nucleic Acids Res.* 25:3389–3402 (1997)). NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In other embodiments, PRO variant polynucleotides are nucleic acid molecules that encode an active PRO polypeptide and which are capable of hybridizing, preferably under stringent hybridization and wash conditions, to nucleotide sequences encoding a full-length PRO polypeptide as disclosed herein. PRO variant polypeptides may be those that are encoded by a PRO variant polynucleotide.

The term "positives", in the context of sequence comparison performed as described above, includes residues in the sequences compared that are not identical but have similar properties (e.g. as a result of conservative substitutions, see Table 6 below). For purposes herein, the % value of positives is determined by dividing (a) the number of amino acid residues scoring a positive value between the PRO polypeptide amino acid sequence of interest having a sequence derived from the native PRO polypeptide sequence and the comparison amino acid sequence of interest (i.e., the amino acid sequence against which the PRO polypeptide sequence is being compared) as determined in the BLOSUM62 matrix of WU-BLAST-2 by (b) the total number of amino acid residues of the PRO polypeptide of interest.

Unless specifically stated otherwise, the % value of positives is calculated as described in the immediately preceding paragraph. However, in the context of the amino acid sequence identity comparisons performed as described for ALIGN-2 and NCBI-BLAST-2 above, includes amino acid residues in the sequences compared that are not only identical, but also those that have similar properties. Amino acid residues that score a positive value to an amino acid residue of interest are those that are either identical to the amino acid residue of interest or are a preferred substitution (as defined in Table 6 below) of the amino acid residue of interest.

For amino acid sequence comparisons using ALIGN-2 or NCBI-BLAST2, the % value of positives of a given amino acid sequence A to, with, or against a given amino acid sequence B (which can alternatively be phrased as a given amino acid sequence A that has or comprises a certain % positives to, with, or against a given amino acid sequence B) is calculated as follows:

100 times the fraction X/Y where X is the number of amino acid residues scoring a positive value as defined above by the sequence alignment program ALIGN-2 or NCBI-BLAST2 in that program's alignment of A and B, and where Y is the total number of amino acid residues in B. It will be appreciated that where the length of amino acid sequence A is not equal to the length of amino acid sequence B, the % positives of A to B will not equal the % positives of B to A.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO polypeptide natural environment will not be present. Ordinarily, however, isolated polypeptide will be prepared by at least one purification step.

An "isolated" PRO polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "antibody" is used in the broadest sense and specifically covers, for example, single anti-PRO monoclonal antibodies (including agonist, antagonist, and neutralizing antibodies), anti-PRO antibody compositions with polyepitopic specificity, single chain anti-PRO antibodies, and fragments of anti-PRO antibodies (see below). The term "monoclonal antibody" as used herein refers to an antibody obtained from a population of substantially homogeneous antibodies, i.e., the individual antibodies comprising the population are identical except for possible naturally-occurring mutations that may be present in minor amounts.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/ 0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodiumphosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37–50° C. The skilled artisan will recognize how to adjust the temperature, ionic strength, etc. as necessary to accommodate factors such as probe length and the like.

The term "epitope tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

As used herein, the term "immunoadhesin" designates antibody-like molecules which combine the binding specificity of a heterologous protein (an "adhesin") with the effector functions of immunoglobulin constant domains. Structurally, the in umunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG4 subtypes, IgA (including IgA-1 and IgA-2), IgE, IgD or IgM.

"Active" or "activity" for the purposes herein refers to form(s) of a PRO polypeptide which retain a biological and/or an immunological activity of native or naturally-occurring PRO, wherein "biological" activity refers to a biological function (either inhibitory or stimulatory) caused by a native or naturally-occurring PRO other than the ability to induce the production of an antibody against an antigenic epitope possessed by a native or naturally-occurring PRO and an "immunological" activity refers to the ability to induce the production of an antibody against an antigenic epitope possessed by a native or naturally-occurring PRO.

The term "antagonist" is used in the broadest sense, and includes any molecule that partially or fully blocks, inhibits, or neutralizes a biological activity of a native PRO polypeptide disclosed herein. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments or amino acid sequence variants of native PRO polypeptides, peptides, antisense oligonucleotides, small organic molecules, etc. Methods for identifying agonists or antagonists of a PRO polypeptide may comprise contacting a PRO polypeptide with a candidate agonist or antagonist molecule and measuring a detectable change in one or more biological activities normally associated with the PRO polypeptide.

"Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are non-toxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., *Protein Eng.* 8(10): 1057–1062 [1995]); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen-combining sites and is still capable of cross-linling antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ diner. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269–315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444–6448 (1993).

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The word "label" when used herein refers to a detectable compound or composition which is conjugated directly or indirectly to the antibody so as to generate a "labeled" antibody. The label may be detectable by itself (e.g. radioisotope labels or fluorescent labels) or, in the case of an enzymatic label, may catalyze chemical alteration of a substrate compound or composition which is detectable.

By "solid phase" is meant a non-aqueous matrix to which the antibody of the present invention can adhere. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a PRO polypeptide or antibody thereto) to a mammal. The components of the liposome are commonly arranged in a bilayer formation, similar to the lipid arrangement of biological membranes.

A "small molecule" is defined herein to have a molecular weight below about 500 Daltons.

As used herein, "vascular endothelial cell growth factor-E," or "VEGF-E," refers to a mammalian growth factor as described herein, including the human amino acid sequence of FIG. 207, a sequence which has homology to VEGF and bone morphogenetic protein 1 and which includes complete conservation of all VEGF cysteine residues, which have been shown to be required for biological activity of VEGF. VEGF-E expression includes expression in human fetal bone, thymus, and the gastrointestinal tract. The biological activity of native VEGF-E is shared by any analogue or variant thereof that is capable of promoting selective growth and/or survival of umbilical vein endothelial cells, induces proliferation of pluripotent fibroblast cells, induces immediate early gene c-fos in human endothelial cell lines and causes myocyte hypertrophy in cardiac cells, or which possesses an immune epitope that is immunologically cross-reactive with an antibody raised against at least one epitope of the corresponding native VEGF-E. The human VEGF-E herein is active on rat and mouse cells indicating conservation across species. Moreover, the VEGF-E herein is expressed at the growth plate region and has been shown to embrace fetal myocytes.

As used herein, "vascular endothelial cell growth factor," or "VEGF," refers to a mammalian growth factor as defined in U.S. Pat. No. 5,332,671. The biological activity of native VEGF is shared by any analogue or variant thereof that is capable of promoting selective growth of vascular endothelial cells but not of bovine corneal endothelial cells, lens epithelial cells, adrenal cortex cells, BHK-21 fibroblasts, or keratinocytes, or that possesses an immune epitope that is immunologically cross-reactive with an antibody raised against at least one epitope of the corresponding native VEGF.

The terms "VEGF-E polypeptide" and "VEGF-E" when used herein encompass native sequence VEGF-E polypeptide and VEGF-E polypeptide variants (which are further defined herein). The VEGF-E polypeptides may be isolated from a variety of sources, such as from human tissue types or from another source, or prepared by recombinant or synthetic methods.

Inhibitors of VEGF-E include those which reduce or inhibit the activity or expression of VEGF-E and includes antisense molecules.

The abbreviation "KDR" refers to the kinase domain region of the VEGF molecule. VEGF-E has no homology with VEGF in this domain.

The abbreviation "FLT-1" refers to the FMS like tyrosine kinase binding domain which is known to bind to the corresponding FLT-1 receptor. VEGF-E has no homology with VEGF in this domain.

"Toll receptor2", "TLR2" and "huTLR2" are used interchangeably, and refer to a human Toll receptor designated as "HuTLR2" by Rock et al., *Proc. Natl. Acad. Sci. USA* 95, 588–593 (1998).

The term "lipopolysaccharide" or "LPS" is used herein as a synonym of "endotoxin." Lipopolysaccharides (LPS) are characteristic components of the outer membrane of Gram-negative bacteria, e.g., *Escherichia coli*. They consist of a polysaccharide part and a fat called lipid A. The polysaccharide, which varies from one bacterial species to another, is made up of the O-specific chain (built from repeating units of three to eight sugars) and the two-part core. Lipid A virtually always includes two glucosamine sugars modified by phosphate and a variable number of fatty acids. For further information see, for example, Rietschel and Brade, *Scientific American* August 1992, 54–61.

The term "septic shock" is used herein in the broadest sense, including all definitions disclosed in Bone, *Ann. Intern Med.* 114, 332–333 (1991). Specifically, septic shock starts with a systemic response to infection, a syndrome called sepsis. When this syndrome results in hypotension and organ dysfunction, it is called septic shock. Septic shock may be initiated by gram-positive organisms and fungi, as well as endotoxin-containing Gram-negative organisms. Accordingly, the present definition is not limited to "endotoxin shock."

The phrases "gene amplification" and "gene duplication" are used interchangeably and refer to a process by which multiple copies of a gene or gene fragment are formed in a particular cell or cell line. The duplicated region (a stretch of amplified DNA) is often referred to as "amplicon". Usually, the amount of the messenger RNA (mRNA) produced, i.e., the level of gene expression, also increases in the proportion of the number of copies made of the particular gene expressed.

"Tumor", as used herein, refers to all neoplastic cell growth and proliferation, whether malignant or benign, and all pre-cancerous and cancerous cells and tissues. The terms "cancer" and "cancerous" refer to or describe the physiological condition in mammals that is typically characterized by unregulated cell growth. Examples of cancer include but are not limited to, carcinoma, lymphoma, blastoma, sarcoma, and leukemia. More particular examples of such cancers include breast cancer, prostate cancer, colon cancer, squamous cell cancer, small-cell lung cancer, non-small cell lung cancer, gastrointestinal cancer, pancreatic cancer, glioblastoma, cervical cancer, ovarian cancer, liver cancer, bladder cancer, hepatoma, colorectal cancer, endometrial carcinoma, salivary gland carcinoma, kidney cancer, vulval cancer, thyroid cancer, hepatic carcinoma and various types of head and neck cancer.

The term "cytotoxic agent" as used herein refers to a substance that inhibits or prevents the function of cells and/or causes destruction of cells. The term is intended to include radioactive isotopes (e.g. I131, I125, Y90 and Re186), chemotherapeutic agents, and toxins such as enzymatically active toxins of bacterial, fungal, plant or animal origin, or fragments thereof.

A "chemotherapeutic agent" is a chemical compound useful in the treatment of cancer. Examples of chemotherapeutic agents include adriamycin, doxorubicin, epirubicin, 5-fluorouracil, cytosine arabinoside ("Ara-C"), cyclophosphamide, thiotepa, busulfan, cytoxin, taxoids, e.g. paclitaxel (Taxol, Bristol-Myers Squibb Oncology, Princeton, N.J.), and doxetaxel (Taxotere, Rhone-Poulenc Rorer, Antony, France), toxotere, methotrexate, cisplatin, melphalan, vinblastine, bleomycin, etoposide, ifosfamide, mitomycin C, mitoxantrone, vincristine, vinorelbine, carboplatin, teniposide, daunomycin, carminomycin, aminopterin, dactinomycin, mitomycins, esperamicins (see U.S. Pat. No. 4,675,187), melphalan and other related nitrogen mustards. Also included in this definition are hormonal agents that act to regulate or inhibit hormone action on tumors such as tamoxifen and onapristone.

A "growth inhibitory agent" when used herein refers to a compound or composition which inhibits growth of a cell, especially cancer cell overexpressing any of the genes identified herein, either in vitro or in vivo. Thus, the growth inhibitory agent is one which significantly reduces the percentage of cells overexpressing such genes in S phase. Examples of growth inhibitory agents include agents that block cell cycle progression (at a place other than S phase), such as agents that induce G1 arrest and M-phase arrest. Classical M-phase blockers include the vincas (vincristine and vinblastine), taxol, and topo II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in The Molecular Basis of Cancer, Mendelsohn and Israel, eds., Chapter 1, entitled "Cell cycle regulation, oncogens, and antineoplastic drugs" by Murakami et al. (WB Saunders: Philadelphia, 1995), especially p. 13.

"Doxorubicin" is an athracycline antibiotic.

The term "cytokine" is a generic term for proteins released by one cell population which act on another cell as intercellular mediators. Examples of such cytokines are lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; and the like. As used herein, the term cytokine includes proteins from natural sources or from recombinant cell culture and biologically active equivalents of the native sequence cytokines.

Table 1

```
/*
 *
 * C-C increased from 12 to 15
 * Z is average of EQ
 * B is average of ND
 * match with stop is _M; stop-stop = 0; J (joker) match = 0
 */
define   _M    -8       /* value of a match with a stop */ int       _day[26][26] = {
/*      A  B  C  D  E  F  G  H  I  J  K  L  M  N  O  P  Q  R  S  T  U  V  W  X  Y  Z */
/* A */ { 2, 0,-2, 0, 0,-4, 1,-1,-1, 0,-1,-2,-1, 0,_M, 1, 0,-2, 1, 1, 0, 0,-6, 0,-3, 0},
/* B */ { 0, 3,-4, 3, 2,-5, 0, 1,-2, 0, 0,-3,-2, 2,_M,-1, 1, 0, 0, 0, 0,-2,-5, 0,-3, 1},
/* C */ {-2,-4,15,-5,-5,-4,-3,-3,-2, 0,-5,-6,-5,-4,_M,-3,-5,-4, 0,-2, 0,-2,-8, 0, 0,-5},
/* D */ { 0, 3,-5, 4, 3,-6, 1, 1,-2, 0, 0,-4,-3, 2,_M,-1, 2,-1, 0, 0, 0,-2,-7, 0,-4, 2},
/* E */ { 0, 2,-5, 3, 4,-5, 0, 1,-2, 0, 0,-3,-2, 1,_M,-1, 2,-1, 0, 0, 0,-2,-7, 0,-4, 3},
/* F */ {-4,-5,-4,-6,-5, 9,-5,-2, 1, 0,-5, 2, 0,-4,_M,-5,-5,-4,-3,-3, 0,-1, 0, 0, 7,-5},
/* G */ { 1, 0,-3, 1, 0,-5, 5,-2,-3, 0,-2,-4,-3, 0,_M,-1,-1,-3, 1, 0, 0,-1,-7, 0,-5, 0},
/* H */ {-1, 1,-3, 1, 1,-2,-2, 6,-2, 0, 0,-2,-2, 2,_M, 0, 3, 2,-1,-1, 0,-2,-3, 0, 0, 2},
/* I */ {-1,-2,-2,-2,-2, 1,-3,-2, 5, 0,-2, 2, 2,-2,_M,-2,-2,-2,-1, 0, 0, 4,-5, 0,-1,-2},
/* J */ { 0, 0, 0, 0, 0, 0, 0, 0, 0, 0, 0, 0, 0, 0,_M, 0, 0, 0, 0, 0, 0, 0, 0, 0, 0, 0},
/* K */ {-1, 0,-5, 0, 0,-5,-2, 0,-2, 0, 5,-3, 0, 1,_M,-1, 1, 3, 0, 0, 0,-2,-3, 0,-4, 0},
/* L */ {-2,-3,-6,-4,-3, 2,-4,-2, 2, 0,-3, 6, 4,-3,_M,-3,-2,-3,-3,-1, 0, 2,-2, 0,-1,-2},
/* M */ {-1,-2,-5,-3,-2, 0,-3,-2, 2, 0, 0, 4, 6,-2,_M,-2,-1, 0,-2,-1, 0, 2,-4, 0,-2,-1},
/* N */ { 0, 2,-4, 2, 1,-4, 0, 2,-2, 0, 1,-3,-2, 2,_M,-1, 1, 0, 1, 0, 0,-2,-4, 0,-2, 1},
/* O */ {_M,_M,_M,_M,_M,_M,_M,_M,_M,_M,_M,_M,_M,_M, 0,_M,_M,_M,_M,_M,_M,_M,_M,_M,_M,_M},
/* P */ { 1,-1,-3,-1,-1,-5,-1, 0,-2, 0,-1,-3,-2,-1,_M, 6, 0, 0, 1, 0, 0,-1,-6, 0,-5, 0},
/* Q */ { 0, 1,-5, 2, 2,-5,-1, 3,-2, 0, 1,-2,-1, 1,_M, 0, 4, 1,-1,-1, 0,-2,-5, 0,-4, 3},
/* R */ {-2, 0,-4,-1,-1,-4,-3, 2,-2, 0, 3,-3, 0, 0,_M, 0, 1, 6, 0,-1, 0,-2, 2, 0,-4, 0},
/* S */ { 1, 0, 0, 0, 0,-3, 1,-1,-1, 0, 0,-3,-2, 1,_M, 1,-1, 0, 2, 1, 0,-1,-2, 0,-3, 0},
/* T */ { 1, 0,-2, 0, 0,-3, 0,-1, 0, 0, 0,-1,-1, 0,_M, 0,-1,-1, 1, 3, 0, 0,-5, 0,-3, 0},
/* U */ { 0, 0, 0, 0, 0, 0, 0, 0, 0, 0, 0, 0, 0, 0,_M, 0, 0, 0, 0, 0, 0, 0, 0, 0, 0, 0},
/* V */ { 0,-2,-2,-2,-2,-1,-1,-2, 4, 0,-2, 2, 2,-2,_M,-1,-2,-2,-1, 0, 0, 4,-6, 0,-2,-2},
/* W */ {-6,-5,-8,-7,-7, 0,-7,-3,-5, 0,-3,-2,-4,-4,_M,-6,-5, 2,-2,-5, 0,-6,17, 0, 0,-6},
/* X */ { 0, 0, 0, 0, 0, 0, 0, 0, 0, 0, 0, 0, 0, 0,_M, 0, 0, 0, 0, 0, 0, 0, 0, 0, 0, 0},
/* Y */ {-3,-3, 0,-4,-4, 7,-5, 0,-1, 0,-4,-1,-2,-2,_M,-5,-4,-4,-3,-3, 0,-2, 0, 0,10,-4},
/* Z */ { 0, 1,-5, 2, 3,-5, 0, 2,-2, 0, 0,-2,-1, 1,_M, 0, 3, 0, 0, 0, 0,-2,-6, 0,-4, 4}
};
```

Table 1 (cont')

```
/*
*/
#include <stdio.h>
include <ctype.h> define  MAXJMP   16      /* max jumps in a diag */
define  MAXGAP   24      /* don't continue to penalize gaps larger than this */
#define  JMPS     1024    /* max jmps in an path */
define  MX       4       /* save if there's at least MX-1 bases since last jmp */ define  DMAT     3       /* value of matching bases */
define  DMIS     0       /* penalty for mismatched bases */
#define  DINS0    8       /* penalty for a gap */
#define  DINS1    1       /* penalty per base */
#define  PINS0    8       /* penalty for a gap */
define  PINS1    4       /* penalty per residue */ struct jmp {
        short           n[MAXJMP];      /* size of jmp (neg for dely) */
        unsigned short  x[MAXJMP];      /* base no. of jmp in seq x */
};                                      /* limits seq to 2^16 -1 */ struct diag {
        int         score;       /* score at last jmp */
        long        offset;      /* offset of prev block */
        short       ijmp;        /* current jmp index */
        struct jmp  jp;          /* list of jmps */
};

struct path {
        int    spc;         /* number of leading spaces */
        short  n[JMPS];     /* size of jmp (gap) */
        int    x[JMPS];     /* loc of jmp (last elem before gap) */
};

char         *ofile;              /* output file name */
char         *namex[2];           /* seq names: getseqs() */
char         *prog;               /* prog name for err msgs */
char         *seqx[2];            /* seqs: getseqs() */
int          dmax;                /* best diag: nw() */
int          dmax0;               /* final diag */
int          dna;                 /* set if dna: main() */
int          endgaps;             /* set if penalizing end gaps */
int          gapx, gapy;          /* total gaps in seqs */
int          len0, len1;          /* seq lens */
int          ngapx, ngapy;        /* total size of gaps */
int          smax;                /* max score: nw() */
int          *xbm;                /* bitmap for matching */
long         offset;              /* current offset in jmp file */
struct diag  *dx;                 /* holds diagonals */
struct path  pp[2];               /* holds path for seqs */ char         *calloc(), *malloc(), *index(), *strcpy();
char         *getseq(), *g_calloc();
```

Table 1 (cont')

```
/* Needleman-Wunsch alignment program
*
* usage: progs file1 file2
* where file1 and file2 are two dna or two protein sequences.
* The sequences can be in upper- or lower-case an may contain ambiguity
* Any lines beginning with ';', '>' or '<' are ignored
* Max file length is 65535 (limited by unsigned short x in the jmp struct)
* A sequence with 1/3 or more of its elements ACGTU is assumed to be DNA
* Output is in the file "align.out"
*
* The program may create a tmp file in /tmp to hold info about traceback.
* Original version developed under BSD 4.3 on a vax 8650
*/
include "nw.h"
#include "day.h"

static   _dbval[26] = {
         1,14,2,13,0,0,4,11,0,0,12,0,3,15,0,0,0,5,6,8,8,7,9,0,10,0
};

static   _pbval[26] = {
         1, 2|(1<<('D'-'A'))|(1<<('N'-'A')), 4, 8, 16, 32, 64,
         128, 256, 0xFFFFFFFF, 1<<10, 1<<11, 1<<12, 1<<13, 1<<14,
         1<<15, 1<<16, 1<<17, 1<<18, 1<<19, 1<<20, 1<<21, 1<<22,
         1<<23, 1<<24, 1<<25|(1<<('E'-'A'))|(1<<('Q'-'A'))
};

main(ac, av)                                                            main
         int      ac;
         char     *av[];
{
         prog = av[0];
         if (ac != 3) {
                  fprintf(stderr,"usage: %s file1 file2\n", prog);
                  fprintf(stderr,"where file1 and file2 are two dna or two protein sequences.\n");
                  fprintf(stderr,"The sequences can be in upper- or lower-case\n");
                  fprintf(stderr,"Any lines beginning with ';' or '<' are ignored\n");
                  fprintf(stderr,"Output is in the file \"align.out\"\n");
                  exit(1);
         }
         namex[0] = av[1];
         namex[1] = av[2];
         seqx[0] = getseq(namex[0], &len0);
         seqx[1] = getseq(namex[1], &len1);
         xbm = (dna)? _dbval : _pbval;

endgaps = 0;              /* 1 to penalize endgaps */
         ofile = "align.out";      /* output file */ nw();                     /* fill in the matrix, get the possible jmps */
         readjmps();               /* get the actual jmps */
         print();                  /* print stats, alignment */ cleanup(0);               /* unlink any tmp files */
}
```

Table 1 (cont')

```
/* do the alignment, return best score: main()
 * dna: values in Fitch and Smith, PNAS, 80, 1382-1386, 1983
 * pro: PAM 250 values
 * When scores are equal, we prefer mismatches to any gap, prefer
 * a new gap to extending an ongoing gap, and prefer a gap in seqx
 * to a gap in seq y.
 */ nw()                                                                                        nw
{
        char        *px, *py;              /* seqs and ptrs */
        int         *ndely, *dely;         /* keep track of dely */
        int         ndelx, delx;           /* keep track of delx */
        int         *tmp;                  /* for swapping row0, row1 */
        int         mis;                   /* score for each type */
        int         ins0, ins1;            /* insertion penalties */
        register    id;                    /* diagonal index */
        register    ij;                    /* jmp index */
        register    *col0, *col1;          /* score for curr, last row */
        register    xx, yy;                /* index into seqs */ dx = (struct diag *)g_calloc("to get diags", len0+len1+1, sizeof(struct diag));

ndely = (int *)g_calloc("to get ndely", len1+1, sizeof(int));
        dely  = (int *)g_calloc("to get dely", len1+1, sizeof(int));
        col0  = (int *)g_calloc("to get col0", len1+1, sizeof(int));
        col1  = (int *)g_calloc("to get col1", len1+1, sizeof(int));
        ins0  = (dna)? DINS0 : PINS0;
        ins1  = (dna)? DINS1 : PINS1;

smax = -10000;
        if (endgaps) {
                for (col0[0] = dely[0] = -ins0, yy = 1; yy <= len1; yy++) {
                        col0[yy] = dely[yy] = col0[yy-1] - ins1;
                        ndely[yy] = yy;
                }
                col0[0] = 0;       /* Waterman Bull Math Biol 84 */
        }
        else
                for (yy = 1; yy <= len1; yy++)
                        dely[yy] = -ins0;

/* fill in match matrix
         */
        for (px = seqx[0], xx = 1; xx <= len0; px++, xx++) {
                /* initialize first entry in col
                 */
                if (endgaps) {
                        if (xx == 1)
                                col1[0] = delx = -(ins0+ins1);
                        else
                                col1[0] = delx = col0[0] - ins1;
                        ndelx = xx;
                }
                else {
                        col1[0] = 0;
                        delx = -ins0;
                        ndelx = 0;
                }
```

Table 1 (cont')

...nw

```
for (py = seqx[1], yy = 1; yy <= len1; py++, yy++) {
        mis = col0[yy-1];
        if (dna)
                mis += (xbm[*px-'A']&xbm[*py-'A'])? DMAT : DMIS;
        else
                mis += _day[*px-'A'][*py-'A'];

/* update penalty for del in x seq;
         * favor new del over ongong del
         * ignore MAXGAP if weighting endgaps
         */
        if (endgaps || ndely[yy] < MAXGAP) {
                if (col0[yy] - ins0 >= dely[yy]) {
                        dely[yy] = col0[yy] - (ins0+ins1);
                        ndely[yy] = 1;
                } else {
                        dely[yy] -= ins1;
                        ndely[yy]++;
                }
        } else {
                if (col0[yy] - (ins0+ins1) >= dely[yy]) {
                        dely[yy] = col0[yy] - (ins0+ins1);
                        ndely[yy] = 1;
                } else
                        ndely[yy]++;
        }

/* update penalty for del in y seq;
         * favor new del over ongong del
         */
        if (endgaps || ndelx < MAXGAP) {
                if (col1[yy-1] - ins0 >= delx) {
                        delx = col1[yy-1] - (ins0+ins1);
                        ndelx = 1;
                } else {
                        delx -= ins1;
                        ndelx++;
                }
        } else {
                if (col1[yy-1] - (ins0+ins1) >= delx) {
                        delx = col1[yy-1] - (ins0+ins1);
                        ndelx = 1;
                } else
                        ndelx++;
        }

/* pick the maximum score; we're favoring
         * mis over any del and delx over dely
         */
```

Table 1 (cont')

...nw

```
                    id = xx - yy + len1 - 1;
                    if (mis > = delx && mis > = dely[yy])
                            col1[yy] = mis;
                    else if (delx > = dely[yy]) {
                            col1[yy] = delx;
                            ij = dx[id].ijmp;
                            if (dx[id].jp.n[0] && (!dna || (ndelx > = MAXJMP
                            && xx > dx[id].jp.x[ij]+MX) || mis > dx[id].score+DINS0)) {
                                    dx[id].ijmp++;
                                    if (++ij > = MAXJMP) {
                                            writejmps(id);
                                            ij = dx[id].ijmp = 0;
                                            dx[id].offset = offset;
                                            offset += sizeof(struct jmp) + sizeof(offset);
                                    }
                            }
                            dx[id].jp.n[ij] = ndelx;
                            dx[id].jp.x[ij] = xx;
                            dx[id].score = delx;
                    }
                    else {
                            col1[yy] = dely[yy];
                            ij = dx[id].ijmp;
            if (dx[id].jp.n[0] && (!dna || (ndely[yy] > = MAXJMP
                            && xx > dx[id].jp.x[ij]+MX) || mis > dx[id].score+DINS0)) {
                                    dx[id].ijmp++;
                                    if (++ij > = MAXJMP) {
                                            writejmps(id);
                                            ij = dx[id].ijmp = 0;
                                            dx[id].offset = offset;
                                            offset += sizeof(struct jmp) + sizeof(offset);
                                    }
                            }
                            dx[id].jp.n[ij] = -ndely[yy];
                            dx[id].jp.x[ij] = xx;
                            dx[id].score = dely[yy];
                    }
                    if (xx == len0 && yy < len1) {
                            /* last col
                            */
                            if (endgaps)
                                    col1[yy] -= ins0+ins1*(len1-yy);
                            if (col1[yy] > smax) {
                                    smax = col1[yy];
                                    dmax = id;
                            }
                    }
            }
            if (endgaps && xx < len0)
                    col1[yy-1] -= ins0+ins1*(len0-xx);
            if (col1[yy-1] > smax) {
                    smax = col1[yy-1];
                    dmax = id;
            }
            tmp = col0; col0 = col1; col1 = tmp;
    }
    (void) free((char *)ndely);
    (void) free((char *)dely);
    (void) free((char *)col0);
    (void) free((char *)col1);
```

Table 1 (cont')

```
/*
 *
 * print() — only routine visible outside this module
 *
 * static:
 * getmat() -- trace back best path, count matches: print()
 * pr_align() -- print alignment of described in array p[]: print()
 * dumpblock() -- dump a block of lines with numbers, stars: pr_align()
 * nums() -- put out a number line: dumpblock()
 * putline() -- put out a line (name, [num], seq, [num]): dumpblock()
 * stars() - -put a line of stars: dumpblock()
 * stripname() -- strip any path and prefix from a seqname
 */ include "nw.h"

define SPC      3
#define P_LINE   256       /* maximum output line */
define P_SPC    3         /* space between name or num and seq */ extern   _day[26][26];
int      olen;             /* set output line length */
FILE     *fx;              /* output file */ print()                                                                 print
{
        int    lx, ly, firstgap, lastgap;    /* overlap */ if ((fx = fopen(ofile, "w")) == 0) {
                fprintf(stderr,"%s: can't write %s\n", prog, ofile);
                cleanup(1);
        }
        fprintf(fx, "<first sequence: %s (length = %d)\n", namex[0], len0);
        fprintf(fx, "<second sequence: %s (length = %d)\n", namex[1], len1);
        olen = 60;
        lx = len0;
        ly = len1;
        firstgap = lastgap = 0;
        if (dmax < len1 - 1) {          /* leading gap in x */
                pp[0].spc = firstgap = len1 - dmax - 1;
                ly -= pp[0].spc;
        }
        else if (dmax > len1 - 1) {     /* leading gap in y */
                pp[1].spc = firstgap = dmax - (len1 - 1);
                lx -= pp[1].spc;
        }
        if (dmax0 < len0 - 1) {         /* trailing gap in x */
                lastgap = len0 - dmax0 -1;
                lx -= lastgap;
        }
        else if (dmax0 > len0 - 1) {    /* trailing gap in y */
                lastgap = dmax0 - (len0 - 1);
                ly -= lastgap;
        }
        getmat(lx, ly, firstgap, lastgap);
        pr_align();
}
```

Table 1 (cont')

```
/*
 * trace back the best path, count matches
 */
static
getmat(lx, ly, firstgap, lastgap)
        int     lx, ly;                /* "core" (minus endgaps) */
        int     firstgap, lastgap;     /* leading trailing overlap */
{
        int             nm, i0, i1, siz0, siz1;
        char            outx[32];
        double          pct;
        register        n0, n1;
        register char   *p0, *p1;

/* get total matches, score
         */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;

nm = 0;
        while ( *p0 && *p1 ) {
                if (siz0) {
                        p1++;
                        n1++;
                        siz0--;
                }
                else if (siz1) {
                        p0++;
                        n0++;
                        siz1--;
                }
                else {
                        if (xbm[*p0-'A']&xbm[*p1-'A'])
                                nm++;
                        if (n0++ == pp[0].x[i0])
                                siz0 = pp[0].n[i0++];
                        if (n1++ == pp[1].x[i1])
                                siz1 = pp[1].n[i1++];
                        p0++;
                        p1++;
                }
        }

/* pct homology:
         * if penalizing endgaps, base is the shorter seq
         * else, knock off overhangs and take shorter core
         */
        if (endgaps)
                lx = (len0 < len1)? len0 : len1;
        else
                lx = (lx < ly)? lx : ly;
        pct = 100.*(double)nm/(double)lx;
        fprintf(fx, "\n");
        fprintf(fx, " < %d match%s in an overlap of %d: %.2f percent similarity\n",
                nm, (nm == 1)? "" : "es", lx, pct);
``` getmat

Table 1 (cont')

```
                fprintf(fx, "<gaps in first sequence: %d", gapx);              ...getmat
        if (gapx) {
                (void) sprintf(outx, " (%d %s%s)",
                        ngapx, (dna)? "base":"residue", (ngapx == 1)? "":"s");
                fprintf(fx,"%s", outx);
        } fprintf(fx, ", gaps in second sequence: %d", gapy);
        if (gapy) {
                (void) sprintf(outx, " (%d %s%s)",
                        ngapy, (dna)? "base":"residue", (ngapy == 1)? "":"s");
                fprintf(fx,"%s", outx);
        }
        if (dna)
                fprintf(fx,
                "\n<score: %d (match = %d, mismatch = %d, gap penalty = %d + %d per base)\n",
                smax, DMAT, DMIS, DINS0, DINS1);
        else
                fprintf(fx,
                "\n<score: %d (Dayhoff PAM 250 matrix, gap penalty = %d + %d per residue)\n",
                smax, PINS0, PINS1);
        if (endgaps)
                fprintf(fx,
                "<endgaps penalized. left endgap: %d %s%s, right endgap: %d %s%s\n",
                firstgap, (dna)? "base" : "residue", (firstgap == 1)? "" : "s",
                lastgap, (dna)? "base" : "residue", (lastgap == 1)? "" : "s");
        else
                fprintf(fx, "<endgaps not penalized\n");
} static          nm;              /* matches in core -- for checking */
static          lmax;            /* lengths of stripped file names */
static          ij[2];           /* jmp index for a path */
static          nc[2];           /* number at start of current line */
static          ni[2];           /* current elem number -- for gapping */
static          siz[2];
static char     *ps[2];          /* ptr to current element */
static char     *po[2];          /* ptr to next output char slot */
static char     out[2][P_LINE];  /* output line */
static char     star[P_LINE];    /* set by stars() */

/*
* print alignment of described in struct path pp[]
*/
static
pr_align()                                                                      pr_align
{
        int       nn;       /* char count */
        int       more;
        register  i;

for (i = 0, lmax = 0; i < 2; i++) {
                nn = stripname(namex[i]);
                if (nn > lmax)
                        lmax = nn;

nc[i] = 1;
                ni[i] = 1;
                siz[i] = ij[i] = 0;
                ps[i] = seqx[i];
                po[i] = out[i];
        }
```

Table 1 (cont')

```
    for (nn = nm = 0, more = 1; more; ) {                                   ...pr_align
            for (i = more = 0; i < 2; i++) {
                    /*
                     * do we have more of this sequence?
                     */
                    if (!*ps[i])
                            continue;

more++;

if (pp[i].spc) {        /* leading space */
                            *po[i]++ = ' ';
                            pp[i].spc--;
                    }
                    else if (siz[i]) {      /* in a gap */
                            *po[i]++ = '-';
                            siz[i]--;
                    }
                    else {                  /* we're putting a seq element
                                             */
                            *po[i] = *ps[i];
                            if (islower(*ps[i]))
                                    *ps[i] = toupper(*ps[i]);
                            po[i]++;
                            ps[i]++;

/*
                             * are we at next gap for this seq?
                             */
                            if (ni[i] == pp[i].x[ij[i]]) {
                                    /*
                                     * we need to merge all gaps
                                     * at this location
                                     */
                                    siz[i] = pp[i].n[ij[i]++];
                                    while (ni[i] == pp[i].x[ij[i]])
                                            siz[i] += pp[i].n[ij[i]++];
                            }
                            ni[i]++;
                    }
            }
            if (++nn == olen || !more && nn) {
                    dumpblock();
                    for (i = 0; i < 2; i++)
                            po[i] = out[i];
                    nn = 0;
            }
    }
}

/*
 * dump a block of lines, including numbers, stars: pr_align()
 */
static
dumpblock()                                                                 dumpblock
{
        register i;

for (i = 0; i < 2; i++)
                *po[i]-- = '\0';
```

Table 1 (cont')

```
                (void) putc('\n', fx);
                for (i = 0; i < 2; i++) {
                        if (*out[i] && (*out[i] != ' ' || *(po[i]) != ' ')) {
                                if (i == 0)
                                        nums(i);
                                if (i == 0 && *out[1])
                                        stars();
                                putline(i);
                                if (i == 0 && *out[1])
                                        fprintf(fx, star);
                                if (i == 1)
                                        nums(i);
                        }
                }
        }
}

/*
 * put out a number line: dumpblock()
 */
static
nums(ix)
        int        ix;        /* index in out[] holding seq line */
{
        char           nline[P_LINE];
        register       i, j;
        register char  *pn, *px, *py;

for (pn = nline, i = 0; i < lmax+P_SPC; i++, pn++)
                *pn = ' ';
        for (i = nc[ix], py = out[ix]; *py; py++, pn++) {
                if (*py == ' ' || *py == '-')
                        *pn = ' ';
                else {
                        if (i%10 == 0 || (i == 1 && nc[ix] != 1)) {
                                j = (i < 0)? -i : i;
                                for (px = pn; j; j /= 10, px--)
                                        *px = j%10 + '0';
                                if (i < 0)
                                        *px = '-';
                        }
                        else
                                *pn = ' ';
                        i++;
                }
        }
        *pn = '\0';
        nc[ix] = i;
        for (pn = nline; *pn; pn++)
                (void) putc(*pn, fx);
        (void) putc('\n', fx);
}

/*
 * put out a line (name, [num], seq, [num]): dumpblock()
 */
static
putline(ix)
        int        ix;
{
```

...dumpblock nums putline

Table 1 (cont')

...putline

```
        int         i;
        register char   *px;

for (px = namex[ix], i = 0; *px && *px != ':'; px++, i++)
                (void) putc(*px, fx);
        for (; i < lmax+P_SPC; i++)
                (void) putc(' ', fx);

/* these count from 1:
         * ni[] is current element (from 1)
         * nc[] is number at start of current line
         */
        for (px = out[ix]; *px; px++)
                (void) putc(*px&0x7F, fx);
        (void) putc('\n', fx);
}

/*
 * put a line of stars (seqs always in out[0], out[1]): dumpblock()
 */
static
stars()
{
        int         i;
        register char   *p0, *p1, cx, *px;

if (!*out[0] || (*out[0] == ' ' && *(po[0]) == ' ') ||
           !*out[1] || (*out[1] == ' ' && *(po[1]) == ' '))
                return;
        px = star;
        for (i = lmax+P_SPC; i; i--)
                *px++ = ' ';

for (p0 = out[0], p1 = out[1]; *p0 && *p1; p0++, p1++) {
                if (isalpha(*p0) && isalpha(*p1)) {
                        if (xbm[*p0-'A']&xbm[*p1-'A']) {
                                cx = '*';
                                nm++;
                        }
                        else if (!dna && _day[*p0-'A'][*p1-'A'] > 0)
                                cx = '.';
                        else
                                cx = ' ';
                }
                else
                        cx = ' ';
                *px++ = cx;
        }
        *px++ = '\n';
        *px = '\0';
}
``` stars

Table 1 (cont')

```
/*
 * strip path or prefix from pn, return len: pr_align()
 */
static
stripname(pn)
        char    *pn;    /* file name (may be path) */
{
        register char   *px, *py;

py = 0;
        for (px = pn; *px; px++)
                if (*px == '/')
                        py = px + 1;
        if (py)
                (void) strcpy(pn, py);
        return(strlen(pn));

}
``` stripname

Table 1 (cont')

```
/*
* cleanup() -- cleanup any tmp file
* getseq() -- read in seq, set dna, len, maxlen
* g_calloc() -- calloc() with error checkin
* readjmps() -- get the good jmps, from tmp file if necessary
* writejmps() -- write a filled array of jmps to a tmp file: nw()
*/
include "nw.h"
include <sys/file.h> char    *jname = "/tmp/homgXXXXXX";      /* tmp file for jmps */
FILE    *fj;

int     cleanup();                        /* cleanup tmp file */
long    lseek();

/*
* remove any tmp file if we blow
*/
cleanup(i)
        int     i;
{
        if (fj)
                (void) unlink(jname);
        exit(i);
}

/*
* read, return ptr to seq, set dna, len, maxlen
* skip lines starting with ';', '<', or '>'
* seq in upper or lower case
*/
char    *
getseq(file, len)
        char    *file;      /* file name */
        int     *len;       /* seq len */
{
        char            line[1024], *pseq;
        register char   *px, *py;
        int             natgc, tlen;
        FILE            *fp;

if ((fp = fopen(file,"r")) == 0) {
                fprintf(stderr,"%s: can't read %s\n", prog, file);
                exit(1);
        }
        tlen = natgc = 0;
        while (fgets(line, 1024, fp)) {
                if (*line == ';' || *line == '<' || *line == '>')
                        continue;
                for (px = line; *px != '\n'; px++)
                        if (isupper(*px) || islower(*px))
                                tlen++;
        }
        if ((pseq = malloc((unsigned)(tlen+6))) == 0) {
                fprintf(stderr,"%s: malloc() failed to get %d bytes for %s\n", prog, tlen+6, file);
                exit(1);
        }
        pseq[0] = pseq[1] = pseq[2] = pseq[3] = '\0';
``` cleanup getseq

Table 1 (cont')

...getseq

```
        py = pseq + 4;
        *len = tlen;
        rewind(fp);

while (fgets(line, 1024, fp)) {
                if (*line == ';' || *line == '<' || *line == '>')
                        continue;
                for (px = line; *px != '\n'; px++) {
                        if (isupper(*px))
                                *py++ = *px;
                        else if (islower(*px))
                                *py++ = toupper(*px);
                        if (index("ATGCU",*(py-1)))
                                natgc++;
                }
        }
        *py++ = '\0';
        *py = '\0';
        (void) fclose(fp);
        dna = natgc > (tlen/3);
        return(pseq+4);
} char    *
g_calloc(msg, nx, sz)
        char    *msg;           /* program, calling routine */
        int     nx, sz;         /* number and size of elements */
{
        char    *px, *calloc();

if ((px = calloc((unsigned)nx, (unsigned)sz)) == 0) {
                if (*msg) {
                        fprintf(stderr, "%s: g_calloc() failed %s (n=%d, sz=%d)\n", prog, msg, nx, sz);
                        exit(1);
                }
        }
        return(px);
}

/*
 * get final jmps from dx[] or tmp file, set pp[], reset dmax: main()
 */
readjmps()
{
        int             fd = -1;
        int             siz, i0, i1;
        register        i, j, xx;

if (fj) {
                (void) fclose(fj);
                if ((fd = open(jname, O_RDONLY, 0)) < 0) {
                        fprintf(stderr, "%s: can't open() %s\n", prog, jname);
                        cleanup(1);
                }
        }
        for (i = i0 = i1 = 0, dmax0 = dmax, xx = len0; ; i++) {
                while (1) {
                        for (j = dx[dmax].ijmp; j >= 0 && dx[dmax].jp.x[j] >= xx; j--)
                                ;
``` g_calloc readjmps

Table 1 (cont')

...readjmps

```
                if (j < 0 && dx[dmax].offset && fj) {
                        (void) lseek(fd, dx[dmax].offset, 0);
                        (void) read(fd, (char *)&dx[dmax].jp, sizeof(struct jmp));
                        (void) read(fd, (char *)&dx[dmax].offset, sizeof(dx[dmax].offset));
                        dx[dmax].ijmp = MAXJMP-1;
                }
                else
                        break;
        }
        if (i >= JMPS) {
                fprintf(stderr, "%s: too many gaps in alignment\n", prog);
                cleanup(1);
        }
        if (j >= 0) {
                siz = dx[dmax].jp.n[j];
                xx = dx[dmax].jp.x[j];
                dmax += siz;
                if (siz < 0) {              /* gap in second seq */
                        pp[1].n[i1] = -siz;
                        xx += siz;
                        /* id = xx - yy + len1 - 1
                        */
                        pp[1].x[i1] = xx - dmax + len1 - 1;
                        gapy++;
                        ngapy -= siz;
/* ignore MAXGAP when doing endgaps */
                        siz = (-siz < MAXGAP || endgaps)? -siz : MAXGAP;
                        i1++;
                }
                else if (siz > 0) {     /* gap in first seq */
                        pp[0].n[i0] = siz;
                        pp[0].x[i0] = xx;
                        gapx++;
                        ngapx += siz;
/* ignore MAXGAP when doing endgaps */
                        siz = (siz < MAXGAP || endgaps)? siz : MAXGAP;
                        i0++;
                }
        }
        else
                break;
}

/* reverse the order of jmps
*/
for (j = 0, i0--; j < i0; j++, i0--) {
        i = pp[0].n[j]; pp[0].n[j] = pp[0].n[i0]; pp[0].n[i0] = i;
        i = pp[0].x[j]; pp[0].x[j] = pp[0].x[i0]; pp[0].x[i0] = i;
}
for (j = 0, i1--; j < i1; j++, i1--) {
        i = pp[1].n[j]; pp[1].n[j] = pp[1].n[i1]; pp[1].n[i1] = i;
        i = pp[1].x[j]; pp[1].x[j] = pp[1].x[i1]; pp[1].x[i1] = i;
}
if (fd >= 0)
        (void) close(fd);
if (fj) {
        (void) unlink(jname);
        fj = 0;
        offset = 0;
}
}
```

Table 1 (cont')

```
/*
 * write a filled jmp struct offset of the prev one (if any): nw()
 */
writejmps(ix)                                                          writejmps
        int     ix;
{
        char    *mktemp();

if (!fj) {
                if (mktemp(jname) < 0) {
                        fprintf(stderr, "%s: can't mktemp() %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| PRO | XXXXXXXXXXXXXXX | (Length = 15 amino acids) |
|---|---|---|
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the PRO polypeptide) = 5 divided by 15 = 33.3%

TABLE 3

| PRO | XXXXXXXXXX | (Length = 10 amino acids) |
|---|---|---|
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the PRO polypeptide) = 5 divided by 10 = 50%

TABLE 4

| PRO-DNA | NNNNNNNNNNNNNN | (Length = 14 nucleotides) |
|---|---|---|
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 6 divided by 14 = 42.9%

TABLE 5

| PRO-DNA | NNNNNNNNNNNN | (Length = 12 nucleotides) |
|---|---|---|
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 4 divided by 12 = 33.3%

II. Compositions and Methods of the Invention

A. Full-Length PRO Pollypeptides

The present invention provides newly identified and isolated nucleotide sequences encoding polypeptides referred to in the present application as PRO polypeptides. In particular, cDNAs encoding various PRO polypeptides have been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by the fill length native nucleic acid molecules disclosed herein as well as all further native homologues and variants included in the foregoing definition of PRO, will be referred to as "PRO/number", regardless of their origin or mode of preparation.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the PRO polypeptides and encoding nucleic acids described herein, Applicants have identified what is believed to be the reading frame best identifiable with the sequence information available at the time.

1. Full-Length PRO213 Polypeptides

The present invention provides newly identified and isolated nucleotide sequences encoding polypeptides referred to in the present application as PRO213. In particular, Applicants have identified and isolated cDNA encoding a PRO213 polypeptide, as disclosed in further detail in the Examples below. Using BLAST and FastA sequence alignment computer programs, Applicants found that a portion of the PRO213 polypeptide has significant homology with the human growth arrest-specific 6 (gas6) protein. Accordingly, it is presently believed that PRO213 polypeptide disclosed in the present application may have the same or similar activity as does the gas6 protein.

2. Full-Length PRO274 Polypeptides

The present invention provides newly identified and isolated nucleotide sequences encoding polypeptides referred to in the present application as PRO274. In particular, Applicants have identified and isolated cDNA encoding a PRO274 polypeptide, as disclosed in further detail in the Examples below. Using BLAST and FastA sequence alignment computer programs, Applicants found that various portions of the PRO274 polypeptide have significant homology with the 7 transmembrane segment receptor proteins and Fn54 protein. Accordingly, it is presently believed that PRO274 polypeptide disclosed in the present application is a newly identified member of the 7 transmembrane segment receptor protein and/or Fn54 protein family.

3. Full-Length PRO300 Polypeptides

The present invention provides newly identified and isolated nucleotide sequences encoding polypeptides referred to in the present application as PRO300. In particular, Applicants have identified and isolated cDNA encoding a PRO300 polypeptide, as disclosed in further detail in the Examples below. Using BLAST and FastA sequence alignment computer programs, Applicants found that various portions of the PRO300 polypeptide have significant homology with the human Diff 33 protein. Accordingly, it is presently believed that PRO300 polypeptide disclosed in the present application is a newly identified member of the Diff 33 family.

4. Full-Length PRO284 Polypeptides

The present invention provides newly identified and isolated nucleotide sequences encoding polypeptides referred to in the present application as PRO284. In particular, Applicants have identified and isolated cDNA encoding a PRO284 polypeptide, as disclosed in further detail in the Examples below. To Applicants present knowledge, the UNQ247 (DNA23318-1211) nucleotide sequence encodes a novel factor; using BLAST and FastA sequence alignment computer programs, no sequence identities to any known proteins were revealed.

5. Full-Length PRO296 Polypeptides

The present invention provides newly identified and isolated nucleotide sequences encoding polypeptides referred to in the present application as PRO296. In particular, Applicants have identified and isolated cDNA encoding a PRO296 polypeptide, as disclosed in further detail in the Examples below. Using BLAST and FastA sequence alignment computer programs, Applicants found that the PRO296 polypeptide has significant similarity to the sarcoma-amplified SAS protein. Accordingly, it is presently believed that PRO296 polypeptide disclosed in the present application is a newly identified SAS protein homolog.

6. Full-Length PRO329 Polypeptides

The present invention provides newly identified and isolated nucleotide sequences encoding polypeptides referred to in the present application as PRO329. In particular, Applicants have identified and isolated cDNA encoding a PRO329 polypeptide, as disclosed in further detail in the Examples below. Using BLAST and FastA sequence alignment computer programs, Applicants found that the PRO329 polypeptide has significant similarity to a high affinity immunoglobulin $F_c$ receptor. Accordingly, it is presently believed that PRO329 polypeptide disclosed in the present application is a newly identified $F_c$ receptor homolog.

7. Full-Length PRO362 Polypeptides

The present invention provides newly identified and isolated nucleotide sequences encoding polypeptides referred to in the present application as PRO362. In particular, Applicants have identified and isolated cDNA encoding a PRO362 polypeptide, as disclosed in further detail in the Examples below. Using BLAST and FastA sequence alignment computer programs, Applicants found that the PRO362 polypeptide has significant similarity to the A33 antigen protein as well as the HCAR protein and the NRCAM related cell adhesion molecule. Accordingly, it is presently believed that PRO362 polypeptide disclosed in the present application is a newly A33 antigen and HCAR protein homolog.

8. Full-Length PRO363 Polypeptides

The present invention provides newly identified and isolated nucleotide sequences encoding polypeptides referred to in the present application as PRO363. In particular, Applicants have identified and isolated cDNA encoding a PRO363 polypeptide, as disclosed in further detail in the Examples below. Using BLAST and FastA sequence alignment computer programs, Applicants found that the PRO363 polypeptide has significant similarity to the cell surface protein HCAR. Accordingly, it is presently believed that PRO363 polypeptide disclosed in the present application is a newly HCAR homolog.

9. Full-Length PRO868 Polypeptides

The present invention provides newly identified and isolated nucleotide sequences encoding polypeptides referred to in the present application as PRO868. In particular, Applicants have identified and isolated cDNA encoding a PRO868 polypeptide, as disclosed in further detail in the Examples below. Using BLAST and FastA sequence alignment computer programs, Applicants found that the PRO868 polypeptide has significant similarity to the tumor necrosis factor receptor. Accordingly, it is presently believed that PRO868 polypeptide disclosed in the present application is a newly identified member of the tumor necrosis factor receptor family of proteins.

10. Full-Length PRO382 Polypeptides

The present invention provides newly identified and isolated nucleotide sequences encoding polypeptides referred to in the present application as PRO382. In particular, Applicants have identified and isolated cDNA encoding a PRO382 polypeptide, as disclosed in further detail in the Examples below. Using BLAST and FastA sequence alignment computer programs, Applicants found that the native PRO382 polypeptide shares significant homology with various serine protease proteins. Applicants have also found that the DNA encoding the PRO382 polypeptide shares significant homology with nucleic acid encoding various serine protease proteins. Accordingly, it is presently believed that PRO382 polypeptide disclosed in the present application is a newly identified serine protease homolog.

11. Full-Length PRO545 Polypeptides

The present invention provides newly identified and isolated nucleotide sequences encoding polypeptides referred to in the present application as PRO545. In particular, Applicants have identified and isolated cDNA encoding a PRO545 polypeptide, as disclosed in further detail in the Examples below. Using BLAST and FastA sequence alignment computer programs, Applicants found that various portions of the PRO545 polypeptide have significant homology with the sequences identified designated as; human metalloproteinase ("P_W01825"), mouse meltrin alpha ("S60257"), metalloprotease disintegrinmeltrin-alpha ("GEN13695"), ADAM 13—*Xenopus laevis* ("XLU66003_1"), mouse meltrin beta ("S60258"), rabbit metalloprotease-disintegrin meltrin-beta, ("GEN13696"), human meltrin S ("AF023477_1"), human meltrin precursor ("AF023476_1"), human ADAM 21 ("AF029900_1"), and human ADAM 20 ("AF029899_1"), thereby indicating that PRO545 may be a novel meltrin protein. Accordingly, it is presently believed that the PRO545 polypeptide disclosed in the present application is a newly identified member of the meltrin family and possesses the cellular adhesiveness typical of the meltrin proteins which comprise both metalloprotease and disintegrin domains.

12. Full-Length PRO617 Polypeptides

The present invention provides newly identified and isolated nucleotide sequences encoding polypeptides referred to in the present application as PRO617. In particular, Applicants have identified and isolated cDNA encoding a PRO617 polypeptide, as disclosed in further detail in the Examples below. Using BLAST and FastA sequence alignment computer programs, Applicants found that the PRO617 polypeptide shares significant homology with the CD24 protein. Applicants have also found that the DNA encoding the PRO617 polypeptide has significant homology with DNA encoding the CD24 protein. Accordingly, it is presently believed that PRO617 polypeptide disclosed in the present application is a newly identified CD24 homolog.

13. Full-Length PRO700 Polypeptides

The present invention provides newly identified and isolated nucleotide sequences encoding polypeptides referred to in the present application as PRO700. In particular, Applicants have identified and isolated cDNA encoding a PRO700 polypeptide, as disclosed in further detail in the Examples below. Analysis of the amino acid sequence of the full-length PRO700 polypeptide using BLAST and FastA sequence alignment computer programs, suggests that various portions of the PRO700 polypeptide possess significant sequence similarity to various protein disulfide isomerases. More specifically, an analysis of the Dayhoff database (version 35.45 SwissProt 35) evidenced significant sequence similarity between the PRO700 amino acid sequence and the following Dayhoff sequences; polypeptide with protein disulfide isomerase activity, designated as ("P_P80664"), human PDI, designated as ("P_R51696"), human PDI, designated as (P_R5297"), probable protein disulfide isomerase er-60 precursor, designated as ("ER60_SCHMA"), protein disulfide isomerase precursor—*Drosophila melanogaster*, designated as ("PDI_LDROME"), protein disulfide-isomerase precursor—*Nicotiana tabaccum*, designated as ("NTPDIGENE_1"), protein disulfide isomerase—*Onchocerca volvulus*, designated as ("OVU12440_1"), human probable protein disulfide isomerase p5 precursor, designated as ("ERP5_HUMAN"), human protein disulfide isomerase-related protein 5, ("HSU79278_1"), and protein disulfide isomerase precursor/propyl 4-hydroxy, ("PDI_HUMAN"), thereby indicating that PRO700 may be a novel protein disulfide isomerase. Accordingly, it is presently believed that PRO700 polypeptide disclosed in the present application is a newly identified member of the protein disulfide isomerase family and possesses the ability to catalyze the formation of disulfide bonds typical of the protein disulfide isomerase family.

14. Full-length PRO702 Polypeptides

The present invention provides newly identified and isolated nucleotide sequences encoding polypeptides referred to in the present application as PRO702. In particular, Applicants have identified and isolated cDNA encoding a PRO702 polypeptide, as disclosed in further detail in the Examples below. Using BLAST and FastA sequence alignment computer programs, Applicants found that the PRO702 polypeptide has significant similarity to the conglutinin protein. Accordingly, it is presently believed that PRO702 polypeptide disclosed in the present application is a newly identified conglutinin homolog.

15. Full-Length PRO703 Polypeptides

The present invention provides newly identified and isolated nucleotide sequences encoding polypeptides referred to in the present application as PRO703. In particular, Applicants have identified and isolated cDNA encoding a PRO703 polypeptide, as disclosed in further detail in the Examples below. Analysis of the amino acid sequence of the full-length PRO703 polypeptide using BLAST and FastA sequence alignment computer programs, suggests that various portions of the PRO703 polypeptide possess significant sequence similarity to the VLCAS protein, thereby indicating that PRO703 may be a novel VLCAS protein. More specifically, an analysis of the Dayhoff database (version 35.45 SwissProt 35) evidenced significant sequence similarity between the PRO703 amino acid sequence and the following Dayhoff sequences, human mRNA for very-long-chain acyl-CoA, ("D88308"), rat mRNA for very-long-chain acyl-CoA synthetase, ("D85100"), *Mus musculus* fatty acid transport protein, ("MMU15976"), human very-long-chain acyl-CoA synthetase, ("D88308_1"), *Mus musculus* very-long-chain acyl-CoA synthetase, ("AF033031_1"), very-long-chain acyl-CoA synthetase—*Rattus*, ("D85100_1"), rat long-chain fatty acid transport protein, ("FATP_RAT"), mouse long-chain fatty acid transport protein, ("FATP_MOUSE"), probable long-chain fatty acid transport protein, ("FAT1_YEAST"), and fatty acid transporter protein, ("CHY15839_2"), thereby indicating that PRO703 may be a novel VLCAS. Accordingly, it is presently believed that PRO703 polypeptide disclosed in the present application is a newly identified member of the VLCAS family and possesses the ability to facilitate the cellular transport of long and very long chain fatty acids typical of the VLCAS family.

16. Full-Length PRO705 Polypeptides

The present invention provides newly identified and isolated nucleotide sequences encoding polypeptides referred to in the present application as PRO705. In particular, Applicants have identified and isolated cDNA encoding a PRO705 polypeptide, as disclosed in further detail in the Examples below. Using BLAST and FastA sequence alignment computer programs, Applicants found that the PRO705 polypeptide has significant similarity to the K-glypican protein. Accordingly, it is presently believed that PRO705 polypeptide disclosed in the present application is a newly identified member of the glypican family of proteoglycan proteins.

17. Full-Length PRO708 Polypeptides

The present invention provides newly identified and isolated nucleotide sequences encoding polypeptides referred to in the present application as PRO708. In particular, Applicants have identified and isolated cDNA encoding a PRO708 polypeptide, as disclosed in further detail in the Examples below. Using BLAST and FastA sequence alignment computer programs, Applicants found that the PRO708 polypeptide has significant homology with the aryl sulfatase proteins. Applicants have also found that the DNA encoding the PRO708 polypeptide has significant homology with DNA encoding the aryl sulfatase proteins. Accordingly, it is presently believed that PRO708 polypeptide disclosed in the present application is a newly identified aryl sulfatase homolog.

18. Full-Length PRO320 Polypeptides

The present invention provides newly identified and isolated nucleotide sequences encoding polypeptides referred to in the present application as PRO320. In particular, Applicants have identified and isolated cDNA encoding a PRO320 polypeptide, as disclosed in further detail in the Examples below. Analysis of the amino acid sequence of the full-length PRO320 polypeptide using BLAST and FastA sequence alignment computer programs, suggests that various portions of the PRO320 polypeptide have significant homology to the fibulin protein. More specifically, an analysis of the Dayhoff database (version 35.45 SwissProt 35) evidenced significant homology between the PRO320 amino acid sequence and the following Dayhoff sequences, human fibulin-2 precursor, designated "FBL2_HUMAN", human fibulin-1 isoform a precursor, designated "FBLA_HUMAN", ZK783.1—*Caenorhabditis elegans*, designated "CELZK783_1", human-notch2, designated "HSU77493_1", Nel protein precursor—*rattus norvegicus*, designated "NEL_RAT", *Mus musculus* cell surface protein, designated "D32210_1", mouse (fragment) Notch B protein, designated "A49175", C50H2.3a—*Caenorhabditis elegans*, designated "CEC50H2_3", MEC-9L—*Caenorhabditis elegans*, designated "CEU33933_1", and *Mus musculus* notch 4, designated "10 MMMHC29N7_2", thereby indicating that PRO320 may be a novel fibulin or fibulin-like protein. Accordingly, it is presently believed that PRO320 polypeptide disclosed in the present application is a newly identified member of the fibulin family and possesses biological activity typical of the fibulin family.

19. Full-Length PRO324 Polypeptides

The present invention provides newly identified and isolated nucleotide sequences encoding polypeptides referred to in the present application as PRO324. In particular, Applicants have identified and isolated cDNA encoding a PRO324 polypeptide, as disclosed in further detail in the Examples below. Using BLAST and FastA sequence alignment computer programs, Applicants found that the PRO324 polypeptide has significant similarity to oxidoreductases. Accordingly, it is presently believed that PRO324 polypeptide disclosed in the present application is a newly identified oxidoreductase homolog.

20. Full-Length PRO351 Polypeptides

The present invention provides newly identified and isolated nucleotide sequences encoding polypeptides referred to in the present application as PRO351. In particular, Applicants have identified and isolated cDNA encoding a PRO351 polypeptide, as disclosed in further detail in the Examples below. Analysis of the amino acid sequence of the full-length PRO351 polypeptide using BLAST and FastA sequence alignment computer programs, suggests that various portions of the PRO351 polypeptide possess significant sequence similarity to the prostasin protein, thereby indicating that PRO351 may be a novel prostasin protein. More specifically, an analysis of the Dayhoff database (version 35.45 SwissProt 35) evidenced significant sequence similarity between the PRO351 amino acid sequence and the following Dayhoff sequences, "AC003965_1", "CELC07G1_7", "GEN12917", "HEPS_HUMAN", "GEN14584", "MCT6_MOUSE", "HSU75329_1", "PLM-N_ERIEU", "TRYB_HUMAN", and "P_W22987". Accordingly, it is presently believed that PRO351 polypeptide disclosed in the present application is a newly identified member of the prostasin family and possesses properties and activities typical of the prostasin family.

21. Full-Length PRO352 Polypeptides

The present invention provides newly identified and isolated nucleotide sequences encoding polypeptides referred to in the present application as PRO352. In particular, Applicants have identified and isolated cDNA encoding a PRO352 polypeptide, as disclosed in further detail in the Examples below. Using BLAST and FastA sequence alignment computer programs, Applicants found that the PRO352 polypeptide has significant similarity to the butyrophilin protein. Accordingly, it is presently believed that PRO352 polypeptide disclosed in the present application is a newly identified butyrophiflin homolog.

22. Full-Length PRO381 Polypeptides

The present invention provides newly identified and isolated nucleotide sequences encoding polypeptides referred to in the present application as PRO381. In particular, Applicants have identified and isolated cDNA encoding a PRO381 polypeptide, as disclosed in further detail in the Examples below. Using BLAST and FastA sequence alignment computer programs, Applicants found that the PRO381 polypeptide has significant similarity to immunophilin proteins. Accordingly, it is presently believed that PRO381 polypeptide disclosed in the present application is a newly identified FKBP immunophilin homolog.

23. Full-Length PRO386 Polypeptides

The present invention provides newly identified and isolated nucleotide sequences encoding polypeptides referred to in the present application as PRO386. In particular, Applicants have identified and isolated cDNA encoding a PRO386 polypeptide, as disclosed in further detail in the Examples below. Using BLAST and FastA sequence alignment computer programs, Applicants found that the PRO386 polypeptide has significant similarity to the beta-2 subunit of a sodium channel protein. Accordingly, it is presently believed that PRO386 polypeptide disclosed in the present application is homolog of a beta-2 subunit of a sodium channel expressed in mammalian cells.

24. Full-Length PRO540 Polypeptides

The present invention provides newly identified and isolated nucleotide sequences encoding polypeptides referred to in the present application as PRO540. In particular, Applicants have identified and isolated cDNA encoding a PRO540 polypeptide, as disclosed in further detail in the Examples below. Analysis of the amino acid sequence of the full-length PRO540 polypeptide using BLAST and FastA sequence alignment computer programs, suggests that various portions of the PRO540 polypeptide possess significant sequence similarity to the LCAT protein, thereby indicating that PRO540 may be a novel LCAT protein. More specifically, an analysis of the Dayhoff database (version 35.45 SwissProt 35) evidenced significant sequence similarity between the PRO540 amino acid sequence and the following Dayhoff sequences, phosphatidylcholine-sterol acyltransferase, designated "LCAT_HUMAN", hypothetical 75.4 kd protein, designated "YN84_YEAST", *Bacillus licheniformis* esterase, designated "BLU35855_1", macrotetrolide resistance protein—*Streptomyces,* designated "JH0655", T-cell receptor delta chain precursor, designated "C30583", Rhesus kringle 2, designated P_W07551", RAGE-1 ORF5, designated "HSU46191_3", human Ig kappa chain VKIII-JK3, designated "HSU07466_1", and *Alstroemeria inodora* reverse transcriptase, designated "ALI223606_1". Accordingly, it is presently believed that PRO540 polypeptide disclosed in the present application is a newly identified member of the LCAT protein family and possesses lipid transport capability typical of the LCAT family.

25. Full-Length PRO615 Polypeptides

The present invention provides newly identified and isolated nucleotide sequences encoding polypeptides referred to in the present application as PRO615. In particular, Applicants have identified and isolated cDNA encoding a PRO615 polypeptide, as disclosed in further detail in the Examples below. Analysis of the amino acid sequence of the full-length PRO615 polypeptide using BLAST and FastA sequence alignment computer programs, suggests that various portions of the PRO615 polypeptide possess significant sequence similarity to the human synaptogyrin protein, thereby indicating that PRO615 may be a novel synaptogyrin protein. More specifically, an analysis of the Dayhoff database (version 35.45 SwissProt 35) evidenced significant sequence similarity between the PRO615 amino acid sequence and the following Dayhoff sequences, "AF039085_1", "RNU39549_1", "CELT08A9_8", "FSU62028_1", "S73645", "Y348_MYCPN", "AC000103_5", "", "RT12_LEITA", and "EBVLMP218_1". Accordingly, it is presently believed that PRO615 polypeptide disclosed in the present application is a newly identified member of the synaptogyrin family and possesses activity and properties typical of the synaptogyrin family.

26. Full-Length PRO618 Polypeptides

The present invention provides newly identified and isolated nucleotide sequences encoding polypeptides referred to in the present application as PRO618. In particular, Applicants have identified and isolated cDNA encoding a PRO618 polypeptide, as disclosed in further detail in the Examples below. Analysis of the amino acid sequence of the full-length PRO618 polypeptide using BLAST and FastA sequence alignment computer programs, suggests that various portions of the PRO618 polypeptide possess significant sequence similarity to the enteropeptidase protein, thereby indicating that PRO618 may be a novel enteropeptidase. More specifically, an analysis of the Dayhoff database (version 35.45 SwissProt 35) evidenced significant sequence similarity between the PRO618 amino acid sequence and the following Dayhoff sequences, "P_W22987", "KAL_HUMAN", "AC003965_1", "GEN12917", "ENTK_HUMAN", "FAll_HUMAN", "HSU75329_1", "P_W22986", and "PLMN_HORSE'. Accordingly, it is presently believed that PRO618 polypeptide disclosed in the present application is a newly identified member of the enteropeptidase family and possesses catalytic activity typical of the enteropeptidase family.

27. Full-Length PRO719 Polypeptides

The present invention provides newly identified and isolated nucleotide sequences encoding polypeptides referred to in the present application as PRO719. In particular, Applicants have identified and isolated cDNA encoding a PRO719 polypeptide, as disclosed in further detail in the Examples below. Using BLAST and FastA sequence alignment computer programs, Applicants found that the PRO719 polypeptide has significant similarity to the lipoprotein lipase H protein. Accordingly, it is presently believed that PRO719 polypeptide disclosed in the present application is a newly identified lipoprotein lipase H homolog.

28. Full-Length PRO724 Polypeptides

The present invention provides newly identified and isolated nucleotide sequences encoding polypeptides referred to in the present application as PRO724. In particular, Applicants have identified and isolated cDNA encoding a PRO724 polypeptide, as disclosed in further detail in the Examples below. Using BLAST and FastA sequence alignment computer programs, Applicants found that the PRO724 polypeptide has significant similarity to the human low density lipoprotein (LDL) receptor protein. Accordingly, it is presently believed that PRO724 polypeptide disclosed in the present application is a newly identified LDL receptor homolog.

29. Full-Length PRO772 Polypeptides

The present invention provides newly identified and isolated nucleotide sequences encoding polypeptides referred to in the present application as PRO772. In particular, Applicants have identified and isolated cDNA encoding a PRO772 polypeptide, as disclosed in further detail in the Examples below. Using BLAST and FastA sequence alignment computer programs, Applicants found that the PRO772 polypeptide has significant similarity to the human A4 protein. Accordingly, it is presently believed that PRO772 polypeptide disclosed in the present application is a newly identified A4 protein homolog.

30. Full-Length PRO852 Polypeptides

The present invention provides newly identified and isolated nucleotide sequences encoding polypeptides referred to in the present application as PRO852. In particular, Applicants have identified and isolated cDNA encoding a PRO852 polypeptide, as disclosed in further detail in the Examples below. Using BLAST and FastA sequence alignment computer programs, Applicants found that the PRO852 polypeptide has significant similarity to various protease proteins. Accordingly, it is presently believed that PRO852 polypeptide disclosed in the present application is a newly identified protease enzyme homolog.

31. Full-Length PRO853 Polypeptides

The present invention provides newly identified and isolated nucleotide sequences encoding polypeptides referred to in the present application as PRO853. In particular, Applicants have identified and isolated cDNA encoding a PRO853 polypeptide, as disclosed in further detail in the Examples below. Analysis of the amino acid sequence of the full-length PRO853 polypeptide using BLAST and FastA sequence alignment computer programs, suggests that various portions of the PRO853 polypeptide possess significant sequence similarity to the reductase protein, thereby indicating that PRO853 may be a novel reductase. More specifically, an analysis of the Dayhoff database (version 35.45 SwissProt 35) evidenced significant sequence similarity between the PRO853 amino acid sequence and the following Dayhoff sequences, "P_W03198", "CEC15H11_6", "MTV030_12", "P_W15759", "S42651", "ATAC00234314", "MTV022_13", "SCU43704_1", "CELE04F6_7", and "ALFA_1". Accordingly, it is presently believed that PRO853 polypeptide disclosed in the present application is a newly identified member of the reductase family and possesses the antioxidant enzymatic activity typical of the reductase family.

32. Full-Length PRO860 Polypeptides

The present invention provides newly identified and isolated nucleotide sequences encoding polypeptides referred to in the present application as PRO860. In particular, Applicants have identified and isolated cDNA encoding a PRO860 polypeptide, as disclosed in further detail in the Examples below. Analysis of the amino acid sequence of the full-length PRO860 polypeptide using BLAST and FastA sequence alignment computer programs, suggests that various portions of the PRO860 polypeptide possess significant sequence similarity to the neurofascin protein, thereby indicating that PRO860 may be a novel neurofascin. More specifically, an analysis of the Dayhoff database (version 35.45 SwissProt 35) evidenced significant sequence similarity between the PRO860 amino acid sequence and the following Dayhoff sequences, "AF040990_1", AF041053_1", "CELZK377_2", "RNU81035_1", "D86983_1", "S26180", "MMBIG2A_1", "S46216", and "RNU68726_1", Accordingly, it is presently believed that PRO860 polypeptide disclosed in the present application is a newly identified member of the neurofascin family and possesses the cellular adhesion properties typical of the neurofascin family.

33. Full-Length PRO846 Polypeptides

The present invention provides newly identified and isolated nucleotide sequences encoding polypeptides referred to in the present application as PRO846. In particular, Applicants have identified and isolated cDNA encoding a PRO846 polypeptide, as disclosed in further detail in the Examples below. Analysis of the amino acid sequence of the full-length PRO846 polypeptide using BLAST and FastA sequence alignment computer programs, suggests that various portions of the PRO846 polypeptide possess significant sequence similarity to the CMRF35 protein, thereby indicating that PRO846 may be a novel CMRF35 protein. More specifically, an analysis of the Dayhoff database (version 35.45 SwissProt 35) evidenced significant sequence similarity between the PRO846 amino acid sequence and the following Dayhoff sequences,"CM35_HUMAN", "AF035963_1", "PIGR_RABIT", "AF043724_1", "RNU89744_1", "A52091_1", "S48841", "ELK06A9_3", and "AF049588_1". Accordingly, it is presently believed that PRO846 polypeptide disclosed in the present application is a newly identified member of the CMRF35 protein family and possesses properties typical of the CMRF35 protein family.

34. Full-Length PRO862 Polypeptides

The present invention provides newly identified and isolated nucleotide sequences encoding polypeptides referred to in the present application as PRO862. In particular, Applicants have identified and isolated cDNA encoding a PRO862 polypeptide, as disclosed in further detail in the Examples below. Analysis of the amino acid sequence of the full-length PRO862 polypeptide using BLAST and FastA sequence alignment computer programs, suggests that various portions of the PRO862 polypeptide possess significant sequence similarity to the lysozyme protein, thereby indicating that PRO862 may be a novel lysozyme protein. More specifically, an analysis of the Dayhoff database (version 35.45 SwissProt 35) evidenced significant sequence similarity between the PRO862 amino acid sequence and the following Dayhoff sequences, "P_P90343", and "LYC_HUMAN. Accordingly, it is presently believed that PRO862 polypeptide disclosed in the present application is a newly identified member of the lysozyme family and possesses catalytic activity typical of the lysozyme family.

35. Full-Length PRO864 Polypeptides

The present invention provides newly identified and isolated nucleotide sequences encoding polypeptides referred to in the present application as PRO864. In particular, Applicants have identified and isolated cDNA encoding a PRO864 polypeptide, as disclosed in further detail in the Examples below. Analysis of the amino acid sequence of the full-length PRO864 polypeptide using BLAST and FastA sequence alignment computer programs, suggests that various portions of the PRO864 polypeptide possess significant sequence similarity to the Wnt-4 protein, thereby indicating that PRO864 may be a novel Wnt4 protein. More specifically, an analysis of the Dayhoff database (version 35.45 SwissProt 35) evidenced significant sequence similarity between the PRO864 amino acid sequence and the following Dayhoff sequences, "WNT4_MOUSE", "WNT3_MOUSE", "WN5A_HUMAN", "WN7B_MOUSE", "WN3A_MOUSE", "XLU66288_1", "WN13_HUMAN", "WN5B_ORYLA", "WNT2_MOUSE", and "WN7A_MOUSE". Accordingly, it is presently believed that PRO864 polypeptide disclosed in the present application is a newly identified member of the Wnt-4 protein family and possesses properties typical of the Wnt-4 protein family.

36. Full-Length PRO792 Polypeptides

The present invention provides newly identified and isolated nucleotide sequences encoding polypeptides referred to in the present application as PRO792. In particular, Applicants have identified and isolated cDNA encoding a PRO792 polypeptide, as disclosed in further detail in the Examples below. Using BLAST and FastA sequence alignment computer programs, Applicants found that the PRO792 polypeptide has significant similarity to the CD23 protein. Accordingly, it is presently believed that PRO792 polypeptide disclosed in the present application is a newly identified CD23 homolog.

37. Full-Length PRO866 Polypeptides

The present invention provides newly identified and isolated nucleotide sequences encoding polypeptides referred to in the present application as PRO866. In particular, Applicants have identified and isolated cDNA encoding a PRO866 polypeptide, as disclosed in further detail in the Examples below. Using BLAST and Tast sequence alignment computer programs, Applicants found that the PRO866 polypeptide has significant similarity to various mindin and spondin proteins. Accordingly, it is presently believed that PRO866 polypeptide disclosed in the present application is a newly identified mindin ispondin homolog.

38. Full-Length PRO871 Polypeptides

The present invention provides newly identified and isolated nucleotide sequences encoding polypeptides referred to in the present application as PRO871. In particular, Applicants have identified and isolated cDNA encoding a PRO871 polypeptide, as disclosed in further detail in the Examples below. Using BLAST and FastA sequence alignment computer programs, Applicants found that the PRO871 polypeptide has significant similarity to the CyP-60 protein. Accordingly, it is presently believed that PRO871 polypeptide disclosed in the present application is a newly identified member of the cyclophilin protein family and possesses activity typical of the cyclophilin protein family.

39. Full-Length PRO873 Polypeptides

The present invention provides newly identified and isolated nucleotide sequences encoding polypeptides referred to in the present application as PRO873. In particular, Applicants have identified and isolated cDNA encoding a PRO873 polypeptide, as disclosed in further detail in the Examples below. Using BLAST and FastA sequence alignment computer programs, Applicants found that the PRO873 polypeptide has significant similarity to a human liver carboxylesterase. Accordingly, it is presently believed that PRO873 polypeptide disclosed in the present application is a newly identified member of the carboxylesterase family and possesses enzymatic activity typical of the carboxylesterase family.

40. Full-Length PRO940 Polypeptides

The present invention provides newly identified and isolated nucleotide sequences encoding polypeptides referred to in the present application as PRO940. In particular, Applicants have identified and isolated cDNA encoding a PRO940 polypeptide, as disclosed in further detail in the Examples below. Using BLAST and FastA sequence alignment computer programs, Applicants found that the PRO940 polypeptide has significant similarity to CD33 and the OB binding protein-2. Accordingly, it is presently believed that PRO940 polypeptide disclosed in the present application is a newly CD33 and/or OB binding protein-2 homolog.

41. Full-Length PRO941 Polypeptides

The present invention provides newly identified and isolated nucleotide sequences encoding polypeptides referred to in the present application as PRO941. In particular, Applicants have identified and isolated cDNA encoding a PRO941 polypeptide, as disclosed in further detail in the Examples below. Using BLAST and FastA sequence alignment computer programs, Applicants found that the PRO941 polypeptide has significant similarity to one or more cadherin proteins. Accordingly, it is presently believed that PRO941 polypeptide disclosed in the present application is a newly identified cadherin homolog.

42. Full-Length PRO944 Polypeptides

The present invention provides newly identified and isolated nucleotide sequences encoding polypeptides referred to in the present application as PRO944. In particular, Applicants have identified and isolated cDNA encoding a PRO944 polypeptide, as disclosed in further detail in the Examples below. Using BLAST and FastA sequence alignment computer programs, Applicants found that the PRO944 polypeptide has significant similarity to the CPE-R cell surface protein. Accordingly, it is presently believed that PRO944 polypeptide disclosed in the present application is a newly identified CPE-R homolog.

43. Full-Length PRO983 Polypeptides

The present invention provides newly identified and isolated nucleotide sequences encoding polypeptides referred to in the present application as PRO983. In particular, Applicants have identified and isolated cDNA encoding a PRO983 polypeptide, as disclosed in further detail in the Examples below. Using BLAST and FastA sequence alignment computer programs, Applicants found that the PRO983 polypeptide has significant similarity to the vesicle-associated protein, VAP-33. Accordingly, it is presently believed that PRO983 polypeptide disclosed in the present application is a newly identified member of the vesicle-associated membrane protein family and possesses activity typical of vesicle-associated membrane proteins.

44. Full-Length PRO1057 Polypeptides

The present invention provides newly identified and isolated nucleotide sequences encoding polypeptides referred to in the present application as PRO 1057. In particular, Applicants have identified and isolated cDNA encoding a PRO1057 polypeptide, as disclosed in further detail in the Examples below. Using BLAST and FastA sequence alignment computer programs, Applicants found that the PRO1057 polypeptide has significant similarity to various protease proteins. Accordingly, it is presently believed that PRO1057 polypeptide disclosed in the present application is a newly identified protease homolog.

45. Full-Length PRO1071 Polypeptides

The present invention provides newly identified and isolated nucleotide sequences encoding polypeptides referred to in the present application as PRO1071. In particular, Applicants have identified and isolated cDNA encoding a PRO1071 polypeptide, as disclosed in further detail in the Examples below. Using BLAST and FastA sequence alignment computer programs, Applicants found that the PRO1071 polypeptide has significant similarity to the thrombospondin protein. Accordingly, it is presently believed that PRO1071 polypeptide disclosed in the present application is a newly identified thrombospondin homolog.

46. Full-Length PRO1072 Polypeptides

The present invention provides newly identified and isolated nucleotide sequences encoding polypeptides referred to in the present application as PRO1072. In particular, Applicants have identified and isolated cDNA encoding a PRO1072 polypeptide, as disclosed in further detail in the Examples below. Using BLAST and FastA sequence alignment computer programs, Applicants found that the PRO1072 polypeptide has significant similarity to various reductase proteins. Accordingly, it is presently believed that PRO1072 polypeptide disclosed in the present application is a newly identified member of the reductase protein family.

47. Full-Length PRO1075 Polypeptides

The present invention provides newly identified and isolated nucleotide sequences encoding polypeptides referred to in the present application as PRO1075. In particular, Applicants have identified and isolated cDNA encoding a PRO1075 polypeptide, as disclosed in further detail in the Examples below. Using BLAST and FastA sequence alignment computer programs, Applicants found that the PRO1075 polypeptide has significant similarity to protein disulfide isomerase. Accordingly, it is presently believed that PRO1075 polypeptide disclosed in the present application is a newly identified member of the protein disulfide isomerase family and possesses activity typical of that family.

48. Full-Length PRO181 Polypeptides

The present invention provides newly identified and isolated nucleotide sequences encoding polypeptides referred to in the present application as PRO181. In particular, Applicants have identified and isolated cDNA encoding a PRO181 polypeptide, as disclosed in further detail in the Examples below. Using BLAST and FastA sequence alignment computer programs, Applicants found that the PRO181 polypeptide has significant similarity to the cornichon protein. Accordingly, it is presently believed that PRO181 polypeptide disclosed in the present application is a newly identified cornichon homolog.

49. Full-Length PRO195 Polypeptides

The present invention provides newly identified and isolated nucleotide sequences encoding polypeptides referred to in the present application as PRO195. In particular, Applicants have identified and isolated cDNA encoding a PRO195 polypeptide, as disclosed in further detail in the Examples below. The PRO195-encoding clone was isolated from a human fetal placenta library using a trapping technique which selects for nucleotide sequences encoding secreted proteins. To Applicants present knowledge, the UNQ169 (DNA26847-1395) nucleotide sequence encodes a novel factor; using BLAST and FastA sequence alignment computer programs, no sequence identities to any known proteins were revealed.

50. Full-Length PRO865 Polypeptides

The present invention provides newly identified and isolated nucleotide sequences encoding polypeptides referred to in the present application as PRO865. In particular, Applicants have identified and isolated cDNA encoding a PRO865 polypeptide, as disclosed in further detail in the Examples below. The PRO865-encoding clone was isolated from a human fetal kidney library using a trapping technique which selects for nucleotide sequences encoding secreted proteins. Thus, the PRO865-encoding clone may encode a secreted factor. To Applicants present knowledge, the UNQ434 (DNA53974-1401) nucleotide sequence encodes a novel factor; using BLAST and FastA sequence alignment computer programs, no sequence identities to any known proteins were revealed.

51. Full-Length PRO827 Polypeptides

The present invention provides newly identified and isolated nucleotide sequences encoding polypeptides referred to in the present application as PRO827. In particular, Applicants have identified and isolated cDNA encoding a PRO827 polypeptide, as disclosed in further detail in the Examples below. Using BLAST and FastA sequence alignment computer programs, Applicants found that the PRO827 polypeptide has significant similarity to VLA-2 and various other integrin proteins. Accordingly, it is presently believed that PRO827 polypeptide disclosed in the present application is a novel integrin protein or splice variant thereof.

52. Full-Length PRO1114 Polypeptides

The present invention provides newly identified and isolated nucleotide sequences encoding polypeptides referred to in the present application as PRO1114. In particular, Applicants have identified and isolated cDNA encoding a PRO1114 polypeptide, as disclosed in further detail in the Examples below. Using BLAST and FastA sequence alignment computer programs, Applicants found that the PRO1114 polypeptide has significant similarity to the cytokine receptor family of proteins. Accordingly, it is presently believed that PRO1114 polypeptide disclosed in the present application is a newly identified member of the cytokine receptor family of proteins and possesses activity typical of that family.

The present invention provides newly identified and isolated nucleotide sequences encoding polypeptides referred to in the present application as PRO1114 interferon receptor (UNQ557). In particular, cDNA encoding a PRO1114 interferon receptor polypeptide has been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by DNA57033-1403 as well as all further native homologues and variants included in the foregoing definition of PRO1114 interferon receptor, will be referred to as "PRO1114 interferon receptor", regardless of their origin or mode of preparation.

Using the WU-BLAST2 sequence alignment computer program, it has been found that a full-length native sequence PRO1114 interferon receptor polypeptide (shown in FIG. 142 and SEQ ID NO:352) has sequence identity with the other known interferon receptors. Accordingly, it is presently believed that PRO1114 interferon receptor possesses activity typical of other interferon receptors.

53. Full-Length PRO237 Polypeptides

The present invention provides newly identified and isolated nucleotide sequences encoding polypeptides referred to in the present application as PRO237. In particular, Applicants have identified and isolated cDNA encoding a PRO237 polypeptide, as disclosed in further detail in the Examples below. Using BLAST and FastA sequence alignment computer programs, Applicants found that the PRO237 polypeptide has significant similarity to carbonic anhydrase. Accordingly, it is presently believed that PRO237 polypeptide disclosed in the present application is a newly identified carbonic anhydrase homolog.

54. Full-Length PRO541 Polypeptides

The present invention provides newly identified and isolated nucleotide sequences encoding polypeptides referred to in the present application as PRO541. In particular, Applicants have identified and isolated cDNA encoding a PRO541 polypeptide, as disclosed in further detail in the Examples below. Using BLAST and FastA sequence alignment computer programs, Applicants found that the PRO541 polypeptide has significant similarity to a trypsin inhibitor protein. Accordingly, it is presently believed that PRO541 polypeptide disclosed in the present application is a newly identified member of the trypsin inhibitor protein family.

55. Full-Length PRO273 Polypeptides

The present invention provides newly identified and isolated nucleotide sequences encoding polypeptides referred to in the present application as PRO273. In particular, Applicants have identified and isolated cDNA encoding a PRO273 polypeptide, as disclosed in further detail in the Examples below. Using BLAST and FastA sequence alignment computer programs, Applicants found that various portions of the PRO273 polypeptide have significant sequence identity with various chemokines. Accordingly, it is presently believed that PRO273 polypeptide disclosed in the present application is a newly identified member of the chemokine family and possesses activity typical of the chemokine family.

56. Full-Length PRO701 Polypeptides

The present invention provides newly identified and isolated nucleotide sequences encoding polypeptides referred to in the present application as PRO701. In particular, Applicants have identified and isolated cDNA encoding a PRO701 polypeptide, as disclosed in further detail in the Examples below. Using BLAST and FastA sequence alignment computer programs, Applicants found that various portions of the PRO701 polypeptide have significant homology with the neuroligins 1, 2 and 3 and esterases including carboxyesterases and acytlcholinesterases. Accordingly, it is presently believed that PRO701 polypeptide disclosed in the present application is a newly identified member of the neuroligin family and is involved in mediating recognition processes between neurons and/or functions as a cell adhesin molecule as is typical of neuroligins.

57. Full-Length PRO704 Polypeptides

The present invention provides newly identified and isolated nucleotide sequences encoding polypeptides referred to in the present application as PRO704. In particular, Applicants have identified and isolated cDNA encoding a PRO704 polypeptide, as disclosed in further detail in the Examples below. Using BLAST and FastA sequence alignment computer programs, Applicants found that various portions of the PRO704 polypeptide have significant homology with the VIP36 and GP36b. Accordingly, it is presently believed that PRO704 polypeptide disclosed in the present application is a newly identified member of the vesicular integral membrane protein family and possesses the ability to bind to sugars and cycle between the plasma membrane and the Golgi typical of this family.

58. Full-Length PRO706 Polypeptides

The present invention provides newly identified and isolated nucleotide sequences encoding polypeptides referred to in the present application as PRO706. In particular, Applicants have identified and isolated cDNA encoding a PRO706 polypeptide, as disclosed in further detail in the Examples below. Using BLAST and FastA sequence alignment computer programs, Applicants found that various portions of the PRO706 polypeptide have sequence identity with the human prostatic acid phosphatase precursor and the human lysosomal acid phosphatase precursor. Accordingly, it is presently believed that PRO706 polypeptide disclosed in the present application is a newly identified member of the human prostatic acid phosphatase precursor family and possesses phosphatase typical of the acid phosphatase family.

59. Full-Length PRO707 Polypeptides

The present invention provides newly identified and isolated nucleotide sequences encoding polypeptides referred to in the present application as PRO707. In particular, Applicants have identified and isolated cDNA encoding a PRO707 polypeptide, as disclosed in further detail in the Examples below. Using BLAST and FastA sequence alignment computer programs, Applicants found that various portions of the PRO707 polypeptide have significant homology with cadherins, particularly cadherin FIB3 found in fibroblasts. Accordingly, it is presently believed that PRO707 polypeptide disclosed in the present application is a newly identified member of the cadherin family and possesses cell interaction signaling typical of the cadherin family.

60. Full-Length PRO322 Polypeptides

The present invention provides newly identified and isolated nucleotide sequences encoding polypeptides referred to in the present application as PRO322. In particular, Applicants have identified and isolated cDNA encoding a PRO322 polypeptide, as disclosed in further detail in the Examples below. Using BLAST and FastA sequence alignment computer programs, Applicants found that various portions of the PRO322 polypeptide have significant homology with human neuropsin, serine protease, neurosin and trypsinogen. Accordingly, it is presently believed that PRO322 polypeptide disclosed in the present application is a newly identified member of the serine protease family and possesses protease activity typical of this family. It is also believed that PRO322 is involved in hippocampal plasticity and is associated with extracellular matrix modifications and cell migrations.

61. Full-Length PRO526 Polypeptides

The present invention provides newly identified and isolated nucleotide sequences encoding polypeptides referred to in the present application as PRO526. In particular, Applicants have identified and isolated cDNA encoding a PRO526 polypeptide, as disclosed in further detail in the Examples below. Using BLAST and FastA sequence alignment computer programs, Applicants found that various portions of the PRO526 polypeptide have significant homology with the acid labile subunit of the insulin-like growth factor complex (ALS), as well carboxypeptidase, SLIT, and platelet glycoprotein V. Accordingly, it is presently believed that PRO526 polypeptide disclosed in the present application is a newly identified member of the leucine-repeat rich superfamily, and possesses protein-protein interaction capabilities typical of this family.

62. Full-Length PRO531 Polypeptides

The present invention provides newly identified and isolated nucleotide sequences encoding polypeptides referred to in the present application as PRO531. In particular, Applicants have identified and isolated cDNA encoding a PRO531 polypeptide, as disclosed in further detail in the Examples below. Using BLAST and FastA sequence alignment computer programs, Applicants found that various portions of the PRO531 polypeptide have significant sequence identity and similarity with members of the cadherin superfamily, particularly, protocadherin 3. Accordingly, it is presently believed that PRO531 polypeptide disclosed in the present application is a newly identified member of the cadherin superfamily, and is a protocadherin. PRO531 is a transmembrane protein which has extracellular cadherin motifs. PRO531 is believed to be involved in cell-cell activity, in particular, cell signaling.

63. Full-Length PRO534 Polypeptides

The present invention provides newly identified and isolated nucleotide sequences encoding polypeptides referred to in the present application as PRO534. In particular, Applicants have identified and isolated cDNA encoding a PRO534 polypeptide, as disclosed in further detail in the Examples below. Using BLAST and FastA sequence alignment computer programs, Applicants found that various portions of the PRO534 polypeptide have significant identity or similarity with the putative disulfide isomerase erp38 precursor and thioredoxin c-3. Accordingly, it is presently believed that PRO534 polypeptide disclosed in the present application is a newly identified member of the disulfide isomerase family and possesses the ability to recognize and unscramble either intermediate or incorrect folding patterns typical of this family.

64. Full-Length PRO697 Polypeptides

The present invention provides newly identified and isolated nucleotide sequences encoding polypeptides referred to in the present application as PRO697. In particular, Applicants have identified and isolated cDNA encoding a PRO697 polypeptide, as disclosed in further detail in the Examples below. Using BLAST and FastA sequence alignment computer programs, Applicants found that various portions of the PRO697 polypeptide have significant identity or similarity with sFRP-2, sFRP-1 and SARP-1, -2 and -3. Accordingly, it is presently believed that PRO697 polypeptide disclosed in the present application is a newly identified member of the sFRP family and possesses activity related to the Wnt signal pathway.

65. Full-Length PRO717 Polypeptides

The present invention provides newly identified and isolated nucleotide sequences encoding polypeptides referred to in the present application as PRO717. In particular, Applicants have identified and isolated cDNA encoding a PRO717 polypeptide, as disclosed in further detail in the Examples below. To Applicants present knowledge, the UNQ385 (DNA50988-1326) nucleotide sequence encodes a novel factor; using BLAST and FastA sequence alignment computer programs, no significant sequence identities to any known human proteins were revealed.

66. Full-Length PRO731 Polypeptides

The present invention provides newly identified and isolated nucleotide sequences encoding polypeptides referred to in the present application as PRO731. In particular, Applicants have identified and isolated cDNA encoding a PRO731 polypeptide, as disclosed in further detail in the Examples below. Using BLAST and FastA sequence alignment computer programs, Applicants found that various portions of the PRO731 polypeptide have significant homology with the protocadherins 4, 68, 43, 42, 3, and 5. Accordingly, it is presently believed that PRO731 polypeptide disclosed in the present application is a newly identified member of the protocadherin family and possesses cell-cell aggregation or signaling activity or signal transduction involvement typical of this family.

67. Full-Length PRO218 Polypeptides

The present invention provides newly identified and isolated nucleotide sequences encoding polypeptides referred to in the present application as PRO218. In particular, Applicants have identified and isolated cDNA encoding a PRO218 polypeptide, as disclosed in further detail in the Examples below. The PRO218-encoding clone was isolated from a human fetal kidney library. To Applicants present knowledge, the UNQ192 (DNA30867-1335) nucleotide sequence encodes a novel factor; using BLAST and FastA sequence alignment computer programs, no significant sequence identities to any known proteins were revealed. Some sequence identity was found with membrane regulator proteins, indicating that PRO218 may function as a membrane regulator.

68. Full-Length PRO768 Polypeptides

The present invention provides newly identified and isolated nucleotide sequences encoding polypeptides referred to in the present application as PRO768. In particular, Applicants have identified and isolated cDNA encoding a PRO768 polypeptide, as disclosed in further detail in the Examples below. Using BLAST and FastA sequence alignment computer programs, Applicants found that various portions of the PRO768 polypeptide have significant homology with integrins, including integrin 7 and 6. Accordingly, it is presently believed that PRO768 polypeptide disclosed in the present application is a newly identified member of the integrin family, either a homologue or a splice variant of integrin 7, and is involved with cell adhesion and communication between muscle cells and the extracellular matrix.

69. Full-Length PRO771 Polypeptides

The present invention provides newly identified and isolated nucleotide sequences encoding polypeptides referred to in the present application as PRO771. In particular, Applicants have identified and isolated cDNA encoding a PRO771 polypeptide, as disclosed in further detail in the Examples below. Using BLAST and FastA sequence alignment computer programs, Applicants found that various portions of the PRO771 polypeptide have significant sequence identity and similarity with testican. Accordingly, it is presently believed that PRO771 polypeptide disclosed in the present application is a newly identified member of the testican family and possesses cell signaling, binding, or adhesion properties, typical of this family.

70. Full-Length PRO733 Polypeptides

The present invention provides newly identified and isolated nucleotide sequences encoding polypeptides referred to in the present application as PRO733. In particular, Applicants have identified and isolated cDNA encoding a PRO733 polypeptide, as disclosed in further detail in the Examples below. Using BLAST and FastA sequence alignment computer programs, Applicants found that various portions of the PRO733 polypeptide have significant sequence identity with the T1/ST receptor binding protein. Accordingly, it is presently believed that PRO733 polypeptide disclosed in the present application is a newly identified member of the interleukin-like family binding proteins which may be a cytokine and which may be involved in cell signaling. It is believed that PRO733 is an ApoAIV homologue.

71. Full-Length PRO162 Polypeptides

The present invention provides newly identified and isolated nucleotide sequences encoding polypeptides referred to in the present application as PRO 162. In particular, Applicants have identified and isolated cDNA encoding a PRO162 polypeptide, as disclosed in further detail in the Examples below. Using BLAST and FastA sequence alignment computer programs, Applicants found that various portions of the PRO162 polypeptide have significant homology with human pancreatitis-associated protein (PAP). Applicants have also found that the DNA encoding the PRO162 polypeptide has significant homology with bovine lithostathine precursor and bovine pancreatic thread protein (PTP). Accordingly, it is presently believed that PRO162 polypeptide disclosed in the present application is a newly identified member of the pancreatitis-associated protein family and possesses activity typical of the pancreatitis-associated protein family.

72. Full-Length PRO788 Polypeptides

The present invention provides newly identified and isolated nucleotide sequences encoding polypeptides referred to in the present application as PRO788. In particular, Applicants have identified and isolated cDNA encoding a PRO788 polypeptide, as disclosed in further detail in the Examples below. Using BLAST and FastA sequence alignment computer programs, Applicants found that various portions of the PRO788 polypeptide have significant homology with the anti-neoplastic urinary protein. Applicants have also found that the DNA encoding the PRO788 polypeptide has significant homology with human E48 antigen, human component B protein, and human prostate stem cell antigen. Accordingly, it is presently believed that PRO788 polypeptide disclosed in the present application is a newly identified member of the anti-neoplastic urinary protein family and possesses anti-neoplastic activity typical of the anti-neoplastic urinary protein family.

73. Full-Length PRO1008 Polypeptides

The present invention provides newly identified and isolated nucleotide sequences encoding polypeptides referred to in the present application as PRO1008. In particular, Applicants have identified and isolated cDNA encoding a PRO1008 polypeptide, as disclosed in further detail in the Examples below. Using BLAST and FastA sequence alignment computer programs, Applicants found that various portions of the PRO1008 polypeptide have significant sequence identity and similarity with mouse dkk-1 (mdkk-1). Accordingly, it is presently believed that PRO1008 polypeptide disclosed in the present application is a newly identified member of the dkk-1 family and possesses head inducing activity typical of this family.

74. Full-Length PRO1012 Polypeptides

The present invention provides newly identified and isolated nucleotide sequences encoding polypeptides referred to in the present application as PRO1012. In particular, Applicants have identified and isolated cDNA encoding a PRO1012 polypeptide, as disclosed in further detail in the Examples below. Using BLAST and FastA sequence alignment computer programs, Applicants found that various portions of the PRO1012 polypeptide have sequence identity with disulfide isomerase. Accordingly, it is presently believed that PRO1012 polypeptide disclosed in the present application is a newly identified member of the ER retained protein family and possesses activity related to the processing, production and/or folding of polypeptides typical of the disulfide isomerase family.

75. Full-Length PRO1014 Polypeptides

The present invention provides newly identified and isolated nucleotide sequences encoding polypeptides referred to in the present application as PRO1014. In particular, Applicants have identified and isolated cDNA encoding a PRO1014 polypeptide, as disclosed in further detail in the Examples below. Using BLAST and FastA sequence alignment computer programs, Applicants found that various portions of the PRO1014 polypeptide have sequence identity with reductase and dehydrogenase. Accordingly, it is presently believed that PRO1014 polypeptide disclosed in the present application is a newly identified member of the reductase super family and possesses reduction capabilities typical of this family.

76. Full-Length PRO1017 Polypeptides

The present invention provides newly identified and isolated nucleotide sequences encoding polypeptides referred to in the present application as PRO1017. In particular, Applicants have identified and isolated cDNA encoding a PRO1017 polypeptide, as disclosed in further detail in the Examples below. Using BLAST and FastA sequence alignment computer programs, Applicants found that various portions of the PRO1017 polypeptide have sequence identity with HNK-1 sulfotransferase. Accordingly, it is presently believed that PRO1017 polypeptide disclosed in the present application is a newly identified member of the HNK-1 sulfotransferase family and is involved with the synthesis of HNK-1 carbohydrate epitopes typical of this family.

77. Full-Length PRO474 Polypeptides

The present invention provides newly identified and isolated nucleotide sequences encoding polypeptides referred to in the present application as PRO474. In particular, Applicants have identified and isolated cDNA encoding a PRO474 polypeptide, as disclosed in further detail in the Examples below. Using BLAST and FastA sequence alignment computer programs, Applicants found that various portions of the PRO474 polypeptide have sequence identity with dehydrogenase, glucose dehydrogenase and oxidoreductase. Accordingly, it is presently believed that PRO474 polypeptide disclosed in the present application is a newly identified member of the dehydrogenase family and is involved in the oxidation of glucose.

78. Full-Length PRO1031 Polypeptides

The present invention provides newly identified and isolated nucleotide sequences encoding polypeptides referred to in the present application as PRO1031. In particular, Applicants have identified and isolated cDNA encoding a PRO1031 polypeptide, as disclosed in further detail in the Examples below. Using BLAST and FastA sequence alignment computer programs, Applicants found that various portions of the PRO1031 polypeptide have sequence identity with IL-17 and CTLA-8. Accordingly, it is presently believed that PRO1031 polypeptide disclosed in the present application is a newly identified member of the cytokine family and thus may be involved in inflammation and/or the immune system.

79. Full-Length PRO938 Polypeptides

The present invention provides newly identified and isolated nucleotide sequences encoding polypeptides referred to in the present application as PRO938. In particular, Applicants have identified and isolated cDNA encoding a PRO938 polypeptide, as disclosed in further detail in the Examples below. Using BLAST and FastA sequence alignment computer programs, Applicants found that the PRO938 polypeptide has significant similarity to protein disulfide isomerase. Accordingly, it is presently believed that PRO938 polypeptide disclosed in the present application is a newly identified member of the thioredoxin family proteins and possesses activity typical of protein disulfide isomerase.

80. Full-Length PRO1082 Polypeptides

The present invention provides newly identified and isolated nucleotide sequences encoding polypeptides referred to in the present application as PRO1082. In particular, Applicants have identified and isolated cDNA encoding a PRO1082 polypeptide, as disclosed in further detail in the Examples below. Using BLAST and FastA sequence alignment computer programs, Applicants found that various portions of the PRO1082 polypeptide have sequence identity with a lectin-like oxidized LDL receptor appearing in the database as "AB010710_1". Accordingly, it is presently believed that PRO1082 polypeptide disclosed in the present application is a newly identified member of the LDL receptor family.

81. Full-Length PRO1083 Polypeptides

The present invention provides newly identified and isolated nucleotide sequences encoding polypeptides referred to in the present application as PRO1083. In particular, Applicants have identified and isolated cDNA encoding a PRO1083 polypeptide, as disclosed in further detail in the Examples below. The PRO1083-encoding clone was isolated from a human fetal kidney library using a trapping technique which selects for nucleotide sequences encoding secreted proteins. To Applicants present knowledge, the UNQ540 (DNA50921-1458) nucleotide sequence encodes a novel factor; using BLAST and FastA sequence alignment computer programs, some sequence identity with a 7TM receptor, latrophilin related protein 1 and a macrophage restricted cell surface glycoprotein was shown. The kinase phosphorylation site and G-coupled receptor domain shown in FIG. 204 indicate that PRO1083 is a novel member of the 7TM receptor superfamily.

82. Full-Length PRO200 Polypeptides

The present invention provides newly identified and isolated nucleotide sequences encoding polypeptides referred to in the present application as VEGF-E. In particular, Applicants have identified and isolated cDNA encoding a VEGF-E polypeptide, as disclosed in further detail in the Examples below. Using BLAST sequence alignment computer programs, Applicants found that the VEGF-E polypeptide has significant homology with VEGF and bone morphogenetic protein 1. In particular, the cDNA sequence of VEGF-E exhibits 24% amino acid similarity with VEGF and has structural conservation. In addition, VEGF-E contains a N-terminal half which is not present in VEGF and that has 28% homology to bone morphogenetic protein 1.

83. Full-Length PRO285 and PRO286 Polypeptides

The present invention provides newly identified and isolated nucleotide sequences encoding polypeptides referred to in the present application as PRO285 and PRO286 In particular, Applicants have identified and isolated cDNAs encoding PRO285 and PRO286 polypeptides, as disclosed in further detail in the Examples below. Using BLAST and FastA sequence alignment computer programs, Applicants found that the coding sequences of PRO285 and PRO286 are highly homologous to DNA sequences HSU88540_1, HSU88878_1, HSU88879_1, HSU88880_1, and HSU88881_1 in the GenBank database.

Accordingly, it is presently believed that the PRO285 and PRO286 proteins disclosed in the present application are newly identified human homologues of the *Drosophila* protein Toll, and are likely to play an important role in adaptive immunity. More specifically, PRO285 and PRO286 may be involved in inflammation, septic shock, and response to pathogens, and play possible roles in diverse medical conditions that are aggravated by immune response, such as, for example, diabetes, ALS, cancer, rheumatoid arthritis, and ulcers. The role of PRO285 and PRO286 as pathogen pattern recognition receptors, sensing the presence of conserved molecular structures present on microbes, is further supported by the data disclosed in the present application, showing that a known human Toll-like receptor, TLR2 is a direct mediator of LPS signaling.

84. Full-Length PRO213-1, PRO1330 and PRO1449 Polypeptides

The present invention provides newly identified and isolated nucleotide sequences encoding polypeptides referred to in the present application as PRO213-1, PRO1330 and/or PRO1449. In particular, cDNA encoding a PRO213-1, PRO1330 and/or PRO1449 polypeptide has been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by DNA30943-1163-1, DNA64907-1163-1 and DNA64908-1163-1 as well as all further native homologues and variants included in the foregoing definition of PRO213-1, PRO1330 and/or PRO1449, will be referred to as "PRO213-1, PRO1330 and/or PRO1449", regardless of their origin or mode of preparation.

85. Full-Length PRO298 Polypeptides

The present invention provides newly identified and isolated nucleotide sequences encoding polypeptides referred to in the present application as PRO298. (It is noted that PRO298 is an arbitrary designation of a protein encoded by the nucleic acid shown in FIG. 218, SEQ ID NO: 514, and having the amino acid sequence shown in FIG. 219, SEQ ID NO:515. Further proteins having the same amino acid sequence but expressed in different rounds of expression, may be given different "PRO" numbers.)

In particular, Applicants have identified and isolated cDNA encoding a PRO298 polypeptide, as disclosed in further detail in the Examples below. Using BLASTX 2.0a8MP-WashU computer program, socring parameters: T=12, S=68, S2=36, Matrix: BLOSUM62, Applicants found that the PRO298 protein specifically disclosed herein shows a limited (27–38%) sequence identity with the following sequences found in the GenBank database: S59392 (probable membrane protein YLR246w—yeast); S58154 (hypothetical protein SPAC2F7.10—yeast); CELF33D11_9 (F33D11.9b—*Caenorhabditis elegans*); YO41_CAEEL (hypothetical 68.7 kd protein zk757.1); CEAC3_5 (AC3.4—*Caenorhabditis elegans*); S52691 (probable transmembrane protein YDR126w—yeast); ATT12H17_14 (protein—*Arabidopsis thaliana*); S55963 (probable membrane protein YNL326c—yeast); CELC43H6_2 (C43H6.7—*Caenorhabditis elegans*); TMO18A10_14 (A_TMO18A10.8—*Arabinosa thaliana*).

86. Full-Length PRO337 Polypeptides

The present invention provides newly identified and isolated nucleotide sequences encoding polypeptides referred to in the present application as PRO337. In particular, Applicants have identified and isolated cDNA encoding a PRO337 polypeptide, as disclosed in further detail in the Examples below. Using BLAST, BLAST-2 and FastA sequence alignment computer programs, Applicants found that a full-length native sequence PRO337 has 97% amino acid sequence identity with rat neurotrimin, 85% sequence identity with chicken CEPU, 73% sequence identity with chicken G55, 59% homology with human LAMP and 84% homology with human OPCAM. Accordingly, it is presently believed that PRO337 disclosed in the present application is a newly identified member of the IgLON sub family of the immunoglobulin superfamily and may possess neurite growth and differentiation potentiating properties.

87. Full-Length PRO403 Polypeptides

The present invention provides newly identified and isolated nucleotide sequences encoding polypeptides referred to in the present application as PRO403. In particular, Applicants have identified and isolated cDNA encoding a PRO403 polypeptide, as disclosed in further detail in the Examples below. Using a BLAST, BLAST-2 and FastA sequence alignment computer programs, Applicants found that a full-length native sequence PRO403 has 94% identity to bovine ECE-2 and 64% identity to human ECE-1. Accordingly is presently believed that PRO403 is a new member of the ECE protein family and may posses ability to catalyze the production of active endothelin.

B. PRO Polypeptide Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO, such as changing the number or position of glycosylation sites or altering the membrane anchoring characteristics.

Variations in the native full-length sequence PRO or in various domains of the PRO described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO that results in a change in the amino acid sequence of the PRO as compared with the native sequence PRO. Optionally the variation is by substitution of at least one amino acid with any other amino acid in one or more of the domains of the PRO. Guidance in determining which amino acid residue may be inserted, substituted or deleted without adversely affecting the desired activity may be found by comparing the sequence of the PRO with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

PRO polypeptide fragments are provided herein. Such fragments may be truncated at the N-terminus or C-terminus, or may lack internal residues, for example, when compared with a full length native protein. Certain fragments lack amino acid residues that are not essential for a desired biological activity of the PRO polypeptide.

PRO fragments may be prepared by any of a number of conventional techniques. Desired peptide fragments may be chemically synthesized. An alternative approach involves generating PRO fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR. Preferably, PRO polypeptide fragments share at least one biological and/or immunological activity with the native PRO polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: norleucine, met, ala, val, leu, ile;
(2) neutral hydrophilic: cys, ser, thr;
(3) acidic: asp, glu;
(4) basic: asn, gln, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.*, 13:4331 (1986); Zoller et al., *Nucl. Acids Res.*, 10:6487 (1987)], cassette mutagenesis [Wells et al., *Gene*, 34:315 (1985)], restriction selection mutagenesis [Wells et al., *Philos. Trans. R. Soc. London SerA*, 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science*, 244: 1081–1085 (1989)]. Alanine is also typically preferred because it is the most common amino acid. Further, it is frequently found in both buried and exposed positions [Creighton, *The Proteins*, (W. H. Freeman & Co., N.Y.); Chothia, *J. Mol. Biol.*, 150:1 (1976)]. If alanine substitution does not yield adequate amounts of variant, an isoteric amino acid can be used.

C. Modifications of PRO

Covalent modifications of PRO are included within the scope of this invention. One type of covalent modification includes reacting targeted amino acid residues of a PRO polypeptide with an organic derivatizing agent that is capable of reacting with selected side chains or the N- or C-terminal residues of the PRO. Derivatization with bifunctional agents is useful, for instance, for crosslinking PRO to a water-insoluble support matrix or surface for use in the method for purifying anti-PRO antibodies, and vice-versa. Commonly used crosslinking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the a-amino groups of lysine, arginine, and histidine side chains [T. E. Creighton, *Proteins: Structure and Molecular Properties*, W. H. Freeman & Co., San Francisco, pp. 79–86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. "Altering the native glycosylation pattern" is intended for purposes herein to mean deleting one or more carbohydrate moieties found in native sequence PRO (either by removing the underlying glycosylation site or by deleting the glycosylation by chemical and/or enzymatic means), and/or adding one or more glycosylation sites that are not present in the native sequence PRO. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO (for O-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published 11, Sep. 1987, and in Aplin and Wriston, *CRC Crit. Rev. Biochem.*, pp. 259–306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Bio phys.*, 259:52 (1987) and by Edge et al., *Anal. Biochem.*, 118:131 (1981). Enzymatic cleavage of carbohydrate moieties on polypeptides can be achieved by the use of a variety of endo- and exo-glycosidases as described by Thotakura et al., *Meth. Enzymol.*, 138:350 (1987).

Another type of covalent modification of PRO comprises linking the PRO polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The PRO of the present invention may also be modified in a way to form a chimeric molecule comprising PRO fused to another, heterologous polypeptide or amino acid sequence.

In one embodiment, such a chimeric molecule comprises a fusion of the PRO with a tag polypeptide which provides an epitope to which an anti-tag antibody can selectively bind. The epitope tag is generally placed at the amino- or carboxyl-terminus of the PRO. The presence of such epitope-tagged forms of the PRO can be detected using an antibody against the tag polypeptide. Also, provision of the epitope tag enables the PRO to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.*, 8:2159–2165 (1988)]; the c-myc tag and the 8F9, 3C7, 6E10, G4, B7 and 9E10 antibodies thereto [Evan et al., *Molecular and Cellular Biology*, 5:3610–3616 (1985)]; and the Herpes Simplex virus glycoprotein D (gD) tag and its antibody [Paborsky et al., *Protein Engineerin g*, 3(6):547–553 (1990)]. Other tag polypeptides include the Flag-peptide [Hopp et al., *BioTechnology*, 6:1204–1210 (1988)]; the KT3 epitope peptide [Martin et al., *Science* 255:192–194 (1992)]; an α-tubulin epitope peptide [Skinner et al., *J. Biol. Chem.*, 266:15163–15166 (1991)]; and the T7 gene 10 protein peptide tag [Lutz-Freyermuth et al., *Proc. Natl. Acad. Sci. USA*, 87:6393–6397 (1990)].

In an alternative embodiment, the chimeric molecule may comprise a fusion of the PRO with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also U.S. Pat. No. 5,428,130 issued Jun. 27, 1995.

D. Preparation of PRO

The description below relates primarily to production of PRO by culturing cells transformed or transfected with a vector containing PRO nucleic acid. It is, of course, contemplated that alternative methods, which are well known in the art, may be employed to prepare PRO. For instance, the PRO sequence, or portions thereof, may be produced by direct peptide synthesis using solid-phase techniques [see, e.g., Stewart et al., *Solid-Phase Peptide Synthesis*, W. H. Freeman Co., San Francisco, Calif. (1969); Merrifield, *J. Am. Chem. Soc.*, 85:2149–2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the PRO may be chemically synthesized separately and combined using chemical or enzymatic methods to produce the full-length PRO.

1. Isolation of DNA Encoding PRO

DNA encoding PRO may be obtained from a cDNA library prepared from tissue believed to possess the PRO mRNA and to express it at a detectable level. Accordingly, human PRO DNA can be conveniently obtained from a cDNA library prepared from human tissue, such as described in the Examples. The PRO-encoding gene may also be obtained from a genomic library or by known synthetic procedures (e.g., automated nucleic acid synthesis).

Libraries can be screened with probes (such as antibodies to the PRO or oligonucleotides of at least about 20–80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding PRO is to use PCR methodology [Sambrook et al., supra; Dieffenbach et al., *PCR Primer: A Laboratory Manual* (Cold Spring Harbor Laboratory Press, 1995)].

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as Gen-Bank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for PRO production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach*, M. Butler, ed. (IRL Press, 1991) and Sambrook et al., supra.

Methods of eukaryotic cell transfection and prokaryotic cell transformation are known to the ordinarily skilled artisan, for example, $CaCl_2$, $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene*, 23:315 (1983) and WO 89/05859 published 29, Jun. 1989. For mammalian cells without such cell walls, the calcium phosphate precipitation method of Graham and van der Eb, *Virology*, 52:456–457 (1978) can be employed. General aspects of mammalian cell host system transfections have been described in U.S. Pat. No. 4,399,216. Transformations into yeast are typically carried out according to the method of Van Solingen et al., *J. Bact.*, 130:946 (1977) and Hsiao et al., *Proc. Natl. Acad. Sci.* (*USA*), 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology*, 185:527–537 (1990) and Mansour et al., *Nature*, 336:348–352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5 772 (ATCC 53,635). Other suitable prokaryotic host cells include Enterobacteriaceae such as *Escherichia*, e.g., *E. coli*, *Enterobacter*, *Erwinia*, *Klebsiella*, *Proteus*, *Salmonella*, e.g., *Salmonella typhinurium*, *Serratia*, e.g., *Serratia marcescans*, and *Shigella*, as well as *Bacilli* such as *B. subtilis* and *B. licheniformis* (e.g., *B. licheniformis* 41P disclosed in DD 266,710 published 12, Apr. 1989), *Pseudomonas* such as *P. aeruginosa*, and *Streptom zyces*. These examples are illustrative rather than limiting. Strain W3110 is one particularly preferred host or parent host because it is a common host strain for recombinant DNA product fermentations. Preferably, the host cell secretes minimal a l amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain 27C7 (ATCC 55,244), which has the complete genotype tonA ptr3phoA E15 (argF-lac)169degP ompT kan$^r$; *E. coli* W3110 strain 37D6, which has the complete genotype tonA ptr3 phoA E15 (argF-lac)169 degP ompT rbs7 ilvG kan$^r$; *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued 7 Aug. 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for PRO-encoding vectors. *Saccharomyces cerevisiae* is a commonly used lower eukaryotic host microorganism. Others include *Schizosaccharotyces pombe* (Beach and Nurse, *Nature*, 290: 140 [1981]; EP 139,383 published 2 May 1985); *Kluyveromyces* hosts (U.S. Pat. No. 4,943,529; Fleer et al., *Bio/Technology*, 9:968–975 (1991)) such as, e.g., *K. lactis* (MW98-8C, CBS683, CBS4574; Louvencourt et al., *J. Bacteriol.*, 154(2):737–742[1983]), *K. fragilis* (ATCC 12,424), *K. Ebulgaricus* (ATCC 16,045), *K. wickeramii* (ATCC 24,178), *K. waltii* (ATCC 56,500), *K. drosophilarum* (ATCC 36,906; Van den Berg et al., *Bio/Technology*, 8:135 (1990)), *K. thernotolerans*, and *K. marxianus; yarrowia* (EP 402,226); *Pichia pastoris* (EP 183,070; Sreekrishna et al., *J. Basic Microbiol.*, 28:265–278 [1988]); *Candida; Trichodenna reesia* (EP 244,234); *Neurospora crassa* (Case et al., *Proc. Natl. Acad. Sci. USA*, 76:5259–5263 [1979]); *Schwannionyces* such as *Schwanniomyces occidentalis* (EP 394,538 published 31, Oct. 1990); and filamentous fungi such as, e.g., *Neurospora, Penicillium, Tolypocladium* (WO 91/00357 published 10, Jan. 1991), and *Aspergillus* hosts such as *A. nidulans* (Ballance et al., *Biochem. Biophys. Res. Commun.*, 112:284–289 [1983]; Tilburn et al., *Gene*, 26:205–221 [1983]; Yelton et al., *Proc. Natl. Acad. Sci. USA*, 81: 1470–1474 [1984]) and *A. niger* (Kelly and Hynes, *EMBO J.*, 4:475–479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, *The Biochemistry of Methylotrophs*, 269 (1982).

Suitable host cells for the expression of glycosylated PRO are derived from multicellular organisms. Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells sub cloned for growth in suspension culture, Graham et al., *J. Gen Virol.*, 36:59 (1977)); Chinese hamster ovary cells/-DHFR (CHO, Urlaub and Chasin, *Proc. Natl. Acad. Sci. USA*, 77:4216 (1980)); mouse sertoli cells (TM4, Mather, *Biol. Reprod.*, 23:243–251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

3. Selection and Use of a Reolicable Vector

The nucleic acid (e.g., cDNA or genomic DNA) encoding PRO may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The PRO may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the PRO-encoding DNA that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including *Saccharomyces* and *Kluyveromyces* α-factor leaders, the latter described in U.S. Pat. No. 5,010, 182), or acid phosphatase leader, the *C. albicans* glucoamylase leader (EP 362,179 published 4 Apr. 1990), or the signal described in WO 90/13646 published 15 Nov. 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for *Bacilli*.

An example of suitable selectable markers for mammalian cells are those that enable the identification of cells competent to take up the PRO-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA*, 77:4216 (1980). A suitable selection gene for use in yeast is the trp1 gene present in the yeast plasmid YRp7 [Stinchcomb et al., *Nature*, 282:39 (1979); Kingsman et al., *Gene*, 7:141 (1979); Tschemper et al., *Gene*, 10:157 (1980)]. The trp1 gene provides a selection marker for a mutant strain of yeast lacking the ability to grow in tryptophan, for example, ATCC No. 44076 or PEP4-1 [Jones, *Genetics*, 85:12 (1977)].

Expression and cloning vectors usually contain a promoter operably linked to the PRO-encoding nucleic acid sequence to direct mRNA synthesis. Promoters recognized by a variety of potential host cells are well known. Promoters suitable for use with prokaryotic hosts include the, β-lactamase and lactose promoter systems [Chang et al., *Nature*, 275:615 (1978); Goeddel et al., *Nature*, 281:544 (1979)], alkaline phosphatase, a tryptophan (trp) promoter system [Goeddel, *Nucleic Acids Res.*, 8:4057 (1980); EP 36,776], and hybrid promoters such as the tac promoter [deBoer et al., *Proc. Natl. Acad. Sci. USA*, 80:21–25 (1983)]. Promoters for use in bacterial systems also will contain a Shine-Dalgarno (S.D.) sequence operably linked to the DNA encoding PRO.

Examples of suitable promoting sequences for use with yeast hosts include the promoters for 3-phosphoglycerate kinase [Hitzeman et al., *J. Biol. Chem.*, 255:2073 (1980)] or other glycolytic enzymes [Hess et al., *J. Adv. Enzyme Reg.*, 7:149 (1968); Holland, *Biochemistry*, 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO transcription from vectors in mammalian host cells is controlled, for example, by promoters obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the PRO by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100–270), the cytomegalovirus early promoter enhancer, the polyoma enhancer on the late side of the replication origin, and adenovirus enhancers. The enhancer may be spliced into the vector at a position 5' or 3' to the PRO coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding PRO.

Still other methods, vectors, and host cells suitable for adaptation to the synthesis of PRO in recombinant vertebrate cell culture are described in Gething et al., *Nature*, 293: 620–625 (1981); Mantei et al., *Nature*, 281:40–46 (1979); EP 117,060; and EP 117,058.

4. Detecting Gene Amplification/Expression

Gene amplification and/or expression may be measured in a sample directly, for example, by conventional Southern blotting, Northern blotting to quantitate the transcription of mRNA [Thomas, *Proc. Natl. Acad. Sci. USA*, 77:5201–5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence PRO polypeptide or against a synthetic peptide based on the DNA sequences provided herein or against exogenous sequence fused to PRO DNA and encoding a specific antibody epitope.

5. Purification of Polypeptide

Forms of PRO may be recovered from culture medium or from host cell lysates. If membrane-bound, it can be released from the membrane using a suitable detergent solution (e.g. Triton-X 100) or by enzymatic cleavage. Cells employed in expression of PRO can be disrupted by various physical or chemical means, such as freeze-thaw cycling, sonication, mechanical disruption, or cell lysing agents.

It may be desired to purify PRO from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contanants such as IgG; and metal chelating columns to bind epitope-tagged forms of the PRO. Various methods of protein purification may be employed and such methods are known in the art and described for example in Deutscher, *Methods in Enzymology*, 182 (1990); Scopes, *Protein Purification: Principles and Practice*, Springer-Verlag, New York (1982). The purification step(s) selected will depend, for example, on the nature of the production process used and the particular PRO produced.

E. Uses for PRO

Nucleotide sequences (or their complement) encoding PRO have various applications in the art of molecular biology, including uses as hybridization probes, in chromosome and gene mapping and in the generation of anti-sense RNA and DNA. PRO nucleic acid will also be useful for the preparation of PRO polypeptides by the recombinant techniques described herein.

The full-length native sequence PRO gene, or portions thereof, may be used as hybridization probes for a cDNA library to isolate the fill-length PRO cDNA or to isolate still other cDNAs (for instance, those encoding naturally-occurring variants of PRO or PRO from other species) which have a desired sequence identity to the native PRO sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence PRO. By way of example, a screening method will comprise isolating the coding region of the PRO gene using the known DNA sequence to synthesize a selected probe of about 40 bases. Hybridization probes may be labeled by a variety of labels, including radionucleotides such as $^{32}$P or $^{35}$S, or enzymatic labels such as alkaline phosphatase coupled to the probe via avidin/biotin coupling systems. Labeled probes having a sequence complementary to that of the PRO gene of the present invention can be used to screen libraries of human cDNA, genomic DNA or mRNA to determine which members of such libraries the probe hybridizes to. Hybridization techniques are described in further detail in the Examples below.

Any EST sequences disclosed in the present application may similarly be employed as probes, using the methods disclosed herein.

Other useful fragments of the PRO nucleic acids include antisense or sense oligonucleotides comprising a singe-stranded nucleic acid sequence (either RNA or DNA) capable of binding to target PRO mRNA (sense) or PRO DNA (antisense) sequences. Antisense or sense oligonucleotides, according to the present invention, comprise a fragment of the coding region of PRO DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. The antisense oligonucleotides thus may be used to block expression of PRO proteins. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, CaPO$_4$-mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 bases in length, about 10 bases in length, about 15 bases in length, about 20 bases in length, about 25 bases in length, about 30 bases in length, about 35 bases in length, about 40 bases in length, about 45 bases in length, about 50 bases in length, about 55 bases in length, about 60 bases in length, about 65 bases in length, about 70 bases in length, about 75 bases in length, about 80 bases in length, about 85 bases in length, about 90 bases in length, about 95 bases in length, about 100 bases in length, or more.

The probes may also be employed in PCR techniques to generate a pool of sequences for identification of closely related PRO coding sequences.

Nucleotide sequences encoding a PRO can also be used to construct hybridization probes for mapping the gene which encodes that PRO and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for PRO encode a protein which binds to another protein (example, where the PRO is a receptor), the PRO can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor PRO can be used to isolate correlative ligand(s). Screening assays can be designed to find lead compounds that mimic the biological activity of a native PRO or a receptor for PRO. Such screening assays win include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

Nucleic acids which encode PRO or its modified forms can also be used to generate either transgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding PRO can be used to clone genomic DNA encoding PRO in accordance with established techniques and the genomic sequences used to generate transgenic animals that contain cells which express DNA encoding PRO. Methods for generating transgenic animals, particularly animals such as mice or rats, have become conventional in the art and are described, for example, in U.S. Pat. Nos. 4,736,866 and 4,870,009. Typically, particular cells would be targeted for PRO transgene incorporation with tissue-specific enhancers. Transgenic animals that include a copy of a transgene encoding PRO introduced into the germ line of the animal at an embryonic stage can be used to examine the effect of increased expression of DNA encoding PRO. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of PRO can be used to construct a PRO "knock out" animal which has a defective or altered gene encoding PRO as a result of homologous recombination between the endogenous gene encoding PRO and altered genomic DNA encoding PRO introduced into an embryonic stem cell of the animal. For example, cDNA encoding PRO can be used to clone genomic DNA encoding PRO in accordance with established techniques. A portion of the genomic DNA encoding PRO can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, Cell, 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., Cell 69:915 (1992)]. The selected cells are then injected into a blastocyst of an animal (e.g., a mouse or rat) to form aggregation chimeras [see e.g., Bradley, in Teratocarcinomas and Embryonic Stem Cells: A Practical Approach, E. J. Robertson, ed. (IRL, Oxford, 1987), pp. 113–152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knockout animals can be characterized for instance, for their ability to defend against certain pathological conditions and for their development of pathological conditions due to absence of the PRO polypeptide.

Nucleic acid encoding the PRO polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., Proc. Natl. Acad. Sci. USA 83:4143–4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., Trends in Biotechnology 11, 205–210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., J. Biol. Chem. 262, 4429–4432 (1987); and Wagner et al., Proc. Natl. Acad. Sci. USA 87, 3410–3414 (1990). For review of gene marking and gene therapy protocols see Anderson et al., Science 256, 808–813 (1992).

The PRO polypeptides described herein may also be employed as molecular weight markers for protein electrophoresis purposes and the isolated nucleic acid sequences may be used for recombinantly expressing those markers.

The nucleic acid molecules encoding the PRO polypeptides or fragments thereof described herein are useful for chromosome identification. In this regard, there exists an ongoing need to identify new chromosome markers, since relatively few chromosome marking reagents, based upon actual sequence data are presently available. Each PRO nucleic acid molecule of the present invention can be used as a chromosome marker.

The PRO polypeptides and nucleic acid molecules of the present invention may also be used for tissue typing, wherein the PRO polypeptides of the present invention may be differentially expressed in one tissue as compared to another. PRO nucleic acid molecules will find use for generating probes for PCR, Northern analysis, Southern analysis and Western analysis.

The PRO polypeptides described herein may also be employed as therapeutic agents. The PRO polypeptides of the present invention can be formulated according to known methods to prepare pharmaceutically useful compositions, whereby the PRO product hereof is combined in admixture with a pharmaceutically acceptable carrier vehicle. Therapeutic formulations are prepared for storage by mixing the active ingredient having the desired degree of purity with optional physiologically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients or stabilizers are nontoxic to recipients at the dosages and concentrations employed, and include buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™ or PEG.

The formulations to be used for in vivo administration must be sterile. This is readily accomplished by filtration through sterile filtration membranes, prior to or following lyophilization and reconstitution.

Therapeutic compositions herein generally are placed into a container having a sterile access port, for example, an intravenous solution bag or vial having a stopper pierceable by a hypodermic injection needle.

The route of administration is in accord with known methods, e.g. injection or infusion by intravenous, intraperitoneal, intracerebral, intramuscular, intraocular, intraarterial or intralesional routes, topical administration, or by sustained release systems.

Dosages and desired drug concentrations of pharmaceutical compositions of the present invention may vary depending on the particular use envisioned. The determination of the appropriate dosage or route of administration is well within the skill of an ordinary physician. Animal experiments provide reliable guidance for the determination of effective doses for human therapy. Interspecies scaling of effective doses can be performed following the principles laid down by Mordenti, J. and Chappell, W. "The use of interspecies scaling in toxicokinetics" In Toxicokinetics and New Drug Development, Yacobi et al., Eds., Pergamon Press, New York 1989, pp. 42–96.

When in vivo administration of a PRO polypeptide or agonist or antagonist thereof is employed, normal dosage amounts may vary from about 10 ng/kg to up to 100 mg/kg of mammal body weight or more per day, preferably about 1 µg/kg/day to 10 mg/kg/day, depending upon the route of administration. Guidance as to particular dosages and methods of delivery is provided in the literature; see, for example, U.S. Pat. Nos. 4,657,760; 5,206,344; or 5,225,212. It is anticipated that different formulations will be effective for different treatment compounds and different disorders, that administration targeting one organ or tissue, for example, may necessitate delivery in a manner different from that to another organ or tissue.

Where sustained-release administration of a PRO polypeptide is desired in a formulation with release characteristics suitable for the treatment of any disease or disorder requiring administration of the PRO polypeptide, microencapsulation of the PRO polypeptide is contemplated. Microencapsulation of recombinant proteins for sustained release has been successfully performed with human growth hormone (rhGH), interferon-(rhIFN-), interleukin-2, and MN rgp120. Johnson et al., *Nat. Med.,* 2:795–799 (1996); Yasuda, *Biomed. Ther.,* 27:1221–1223 (1993); Hora et al., *Bio/Technology,* 8:755–758 (1990); Cleland, "Design and Production of Single Immunization Vaccines Using Poly-lactide Polyglycolide Microsphere Systems," in *Vaccine Design: The Subunit and Adjuvant Approach*, Powell and Newman, eds, (Plenum Press: New York, 1995), pp. 439–462; WO 97/03692, WO 96/40072, WO 96/07399; and U.S. Pat. No. 5,654,010.

The sustained-release formulations of these proteins were developed using poly4actic-coglycolic acid (PLGA) polymer due to its biocompatibility and wide range of biodegradable properties. The degradation products of PLGA, lactic and glycolic acids, can be cleared quickly within the human body. Moreover, the degradability of this polymer can be adjusted from months to years depending on its molecular weight and composition. Lewis, "Controlled release of bioactive agents from lactide/glycolide polymer," in: M. Chasin and R. Langer (Eds.), *Biodegradable Polymers as Drug Delivery Systems* (Marcel Dekker: New York, 1990), pp. 1–41.

This invention encompasses methods of screening compounds to identify those that mimic the PRO polypeptide (agonists) or prevent the effect of the PRO polypeptide (antagonists). Screening assays for antagonist drug candidates are designed to identify compounds that bind or complex with the PRO polypeptides encoded by the genes identified herein, or otherwise interfere with the interaction of the encoded polypeptides with other cellular proteins. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a PRO polypeptide encoded by a nucleic acid identified herein under conditions and for a time sufficient to allow these two components to interact.

In binding assays, the interaction is binding and the complex formed can be isolated or detected in the reaction mixture. In a particular embodiment, the PRO polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the PRO polypeptide and drying. Alternatively, an immobilized antibody, e.g., a monoclonal antibody, specific for the PRO polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular PRO polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature (London)*, 340:245–246 (1989); Chien et al., *Proc. Natl. Acad. Sci. USA*, 88:9578–9582 (1991)) as disclosed by Chevray and Nathans, *Proc. Natl. Acad. Sci. USA*, 89: 5789–5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAl4-activated promoter depends on reconstitution of GAL4 activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a PRO polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the PRO polypeptide may be added to a cell along with the compound to be screened for a particular activity and the ability of the compound to inhibit the activity of interest in the presence of the PRO polypeptide indicates that the compound is an antagonist to the PRO polypeptide. Alternatively, antagonists may be detected by combining the PRO polypeptide and a potential antagonist with membrane-bound PRO polypeptide receptors or recombinant receptors under appropriate conditions for a competitive inhibition assay. The PRO polypeptide can be labeled, such as by radioactivity, such that the number of PRO polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.*, 1(2): Chapter 5 (1991). Preferably, expression cloning is employed wherein polyadenylated RNA is prepared from a cell responsive to the PRO polypeptide and a cDNA library created from this RNA is divided into pools and used to transfect COS cells or other cells that are not responsive to the PRO polypeptide. Transfected cells that are grown on glass slides are exposed to labeled PRO polypeptide. The PRO polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled PRO polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled PRO polypeptide in the presence of the candidate compound. The ability of the compound to enhance or block this interaction could then be measured.

More specific examples of potential antagonists include an oligonucleotide that binds to the fusions of immunoglobulin with PRO polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the PRO polypeptide that recognizes the receptor but imparts no effect, thereby competitively inhibiting the action of the PRO polypeptide.

Another potential PRO polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature PRO polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.*, 6:3073 (1979); Cooney et al., *Science*, 241: 456 (1988); Dervan et al., *Science*, 251:1360 (1991)), thereby preventing transcription and the production of the PRO polypeptide. The antisense RNA oligonucleotide hybridizes to the mRNA in vivo and blocks translation of the mRNA molecule into the PRO polypeptide (antisense—Okano, *Neurochem.*, 56:560 (1991); *Oligodeoxynucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the PRO polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the PRO polypeptide, thereby blocking the normal biological activity of the PRO polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see,e.g., Rossi, Current Biology,4:469471(1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

PRO213 polypeptides and portions thereof which possess the ability to regulate the growth induction cascade and/or the blood coagulation cascade may also be employed for such purposes both in vivo therapy and in vitro. Those of ordinary skill in the art will well know how to employ PRO213 polypeptides for such uses.

PRO274 polypeptides and portions thereof which have homology to 7TM protein and Fn54 may also be useful for in vivo therapeutic purposes, as well as for various other applications. The identification of novel 7TM protein and Fn54-like molecules may have relevance to a number of human disorders which involve recognition of ligands and the subsequent signal transduction of information contained within those ligands in order to control cellular processes. Thus, the identification of new 7TM protein and Fn54-like molecules is of special importance in that such proteins may serve as potential therapeutics for a variety of different human disorders. Such polypeptides may also play important roles in biotechnological and medical research as well as in various industrial applications. As a result, there is particular scientific and medical interest in new molecules, such as PRO274.

PRO300 polypeptides and portions thereof which have homology to Diff 33 may also be useful for in vivo therapeutic purposes, as well as for various other applications. The identification of novel Diff 33-like molecules may have relevance to a number of human disorders such as the physiology of cancer. Thus, the identification of new Diff 334like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO300.

PRO296 polypeptides of the present invention which possess biological activity related to that of the sarcoma-amplified SAS protein may be employed both in vivo for therapeutic purposes and in vitro. Those of ordinary skill in the art will well know how to employ the PRO296 polypeptides of the present invention for such purposes.

PRO329 polypeptides of the present invention which possess biological activity related to that of immunoglobulin $F_c$ receptor protein or subunit thereof may be employed both in vivo for therapeutic purposes and in vitro. Those of ordinary skill in the art will well know how to employ the PRO329 polypeptides of the present invention for such purposes.

PRO362 polypeptides of the present invention which possess biological activity related to that of the A33 antigen protein, HCAR protein or the NrCAM related cell adhesion molecule may be employed both in vivo for therapeutic purposes and in vitro.

PRO363 polypeptides of the present invention which possess biological activity related to that of the cell surface HCAR protein may be employed both in vivo for therapeutic purposes and in vitro. Those of ordinary skill in the art will well know how to employ the PRO363 polypeptides of the present invention for such purposes. Specifically, extracellular domains derived from the PRO363 polypeptides may be employed therapeutically in vivo for lessening the effects of viral infection.

PRO868 polypeptides of the present invention which possess biological activity related to that of the tumor necrosis factor protein may be employed both in vivo for therapeutic purposes and in vitro. Those of ordinary skill in the art will well know how to employ the PRO868 polypeptides of the present invention for such purposes.

PRO382 polypeptides of the present invention which possess biological activity related to that of the serine protease proteins may be employed both in vivo for therapeutic purposes and in vitro. Those of ordinary skill in the art will well know how to employ the PRO382 polypeptides of the present invention for such purposes.

PRO545 polypeptides and portions thereof which have homology to meltrin may also be useful for in vivo therapeutic purposes, as well as for various other applications. The identification of novel molecules associated with cellular adhesion may be relevant to a number of human disorders. Given that the meltrin proteins may play an important role in a number of disease processes, the identification of new meltrin proteins and meltrin-like molecules is of special importance in that such proteins may serve as potential therapeutics for a variety of different human disorders. Such polypeptides may also play important roles in biotechnological and medical research, as well as various industrial applications. As a result, there is particular scientific and medical interest in new molecules, such as PRO545.

PRO617 polypeptides of the present invention which possess biological activity related to that of the CD24 protein may be employed both in vivo for therapeutic purposes and in vitro. Those of ordinary skill in the art will well know how to employ the PRO617 polypeptides of the present invention for such purposes.

PRO700 polypeptides and portions thereof which have homology to protein disulfide isomerase may also be useful for in vivo therapeutic purposes, as well as various other applications. The identification of novel protein disulfide isomerases and related molecules may be relevant to a number of human disorders. Given that formation of disulfide bonds and protein folding play important roles in a number of biological processes, the identification of new protein disulfide isomerases and protein disulfide isomerase-like molecules is of special importance in that such proteins may serve as potential therapeutics for a variety of different human disorders. Such polypeptides may also play important roles in biotechnological and medical research, as well as various industrial applications. As a result, there is particular scientific and medical interest in new molecules, such as PRO700.

PRO702 polypeptides of the present invention which possess biological activity related to that of the conglutinin protein may be employed both in vivo for therapeutic purposes and in vitro. Those of ordinary skill in the art will well know how to employ the PRO702 polypeptides of the present invention for such purposes. PRO702 polypeptides having conglutinin activity would be expected to be capable of inhibiting haemagglutinin activity by influenza viruses and/or function as immunoglobulin-independent defense molecules as a result of a complement-mediated mechanism.

PRO703 polypeptides of the present invention which possess biological activity related to that of the VLCAS protein may be employed both in vivo for therapeutic purposes and in vitro. Those of ordinary skill in the art will well know how to employ the PRO703 polypeptides of the present invention for such purposes.

PRO703 polypeptides and portions thereof which have homology to VLCAS may also be useful for in vivo therapeutic purposes, as well as for various other applications. The identification of novel VLCAS proteins and related molecules may be relevant to a number of human disorders. Thus, the identification of new VLCAS proteins and VLCAS protein-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO703.

PRO705 polypeptides of the present invention which possess biological activity related to that of the K-glypican protein may be employed both in vivo for therapeutic purposes and in vitro. Those of ordinary skill in the art will well know how to employ the PRO705 polypeptides of the present invention for such purposes.

PRO708 polypeptides of the present invention which possess biological activity related to that of the aryl sulfatase proteins may be employed both in vivo for therapeutic purposes and in vitro. Those of ordinary skill in the art will well know how to employ the PRO708 polypeptides of the present invention for such purposes.

PRO320 polypeptides of the present invention which possess biological activity related to that of the fibulin protein may be employed both in vivo for therapeutic purposes and in vitro. Those of ordinary skill in the art will well know how to employ the PRO320 polypeptides of the present invention for such purposes.

PRO320 polypeptides and portions thereof which have homology to fibulin may also be useful for in vivo therapeutic purposes, as well as for various other applications. The identification of novel fibulin proteins and related molecules may be relevant to a number of human disorders such as cancer or those involving connective tissue, attachment molecules and related mechanisms. Thus, the identification of new fibulin proteins and fibulin protein-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO320.

PRO324 polypeptides of the present invention which possess biological activity related to that of oxidoreductases may be employed both in vivo for therapeutic purposes and in vitro. Those of ordinary skill in the art will well know how to employ the PRO324 polypeptides of the present invention for such purposes.

PRO351 polypeptides of the present invention which possess biological activity related to that of the prostasin protein may be employed both in vivo for therapeutic purposes and in vitro. Those of ordinary skill in the art will well know how to employ the PRO351 polypeptides of the present invention for such purposes.

PRO351 polypeptides and portions thereof which have homology to prostasin may also be useful for in vivo therapeutic purposes, as well as for various other applications. The identification of novelprostasin proteins and related molecules may be relevant to a number of human disorders. Thus, the identification of new prostasin proteins and prostasin-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO351.

PRO352 polypeptides of the present invention which possess biological activity related to that of the butyrophilin protein may be employed both in vivo for therapeutic purposes and in vitro. Those of ordinary skill in the art will well know how to employ the PRO352 polypeptides of the present invention for such purposes.

PRO381 polypeptides of the present invention which possess biological activity related to that of one or more of the FKPB immunophilin proteins may be employed both in vivo for therapeutic purposes and in vitro, for example for enhancing immunosuppressant activity and/or for axonal regeneration. Those of ordinary skill in the art will well know how to employ the PRO381 polypeptides of the present invention for such purposes.

PRO386 polypeptides of the present invention which possess biological activity related to that of the beta-2 subunit of a sodium channel expressed in mammalian cells may be employed both in vivo for therapeutic purposes and in vitro. Those of ordinary skill in the art will well know how to employ the PRO386 polypeptides of the present invention for such purposes.

PRO540 polypeptides of the present invention which possess biological activity related to that of the LCAT protein may be employed both in vivo for therapeutic purposes and in vitro. Those of ordinary skill in the art will well know how to employ the PRO540 polypeptides of the present invention for such purposes.

PRO615 polypeptides of the present invention which possess biological activity related to that of the synaptogyrin protein may be employed both in vivo for therapeutic purposes and in vitro. Those of ordinary skill in the art will well know how to employ the PRO615 polypeptides of the present invention for such purposes.

PRO615 polypeptides and portions thereof which have homology to synaptogyrin may also be useful for in vivo therapeutic purposes, as well as for various other applications. The identification of novel synaptogyrin proteins and related molecules may be relevant to a number of human disorders. Thus, the identification of new synaptogyrin proteins and synaptogyrin-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO615.

PRO618 polypeptides of the present invention which possess biological activity related to that of an enteropeptidase may be employed both in vivo for therapeutic purposes and in vitro. Those of ordinary skill in the art will well know how to employ the PRO618 polypeptides of the present invention for such purposes.

PRO618 polypeptides and portions thereof which have homology to enteropeptidase may also be useful for in vivo therapeutic purposes, as well as for various other applications. The identification of novel enteropeptidase proteins and related molecules may be relevant to a number of human disorders. Thus, the identification of new enteropeptidase proteins and enteropeptidase-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO618.

PRO719 polypeptides of the present invention which possess biological activity related to that of the lipoprotein lipase H protein may be employed both in vivo for therapeutic purposes and in vitro. Those of ordinary skill in the art will well know how to employ the PRO719 polypeptides of the present invention for such purposes.

PRO724 polypeptides of the present invention which possess biological activity related to that of the human LDL receptor protein may be employed both in vivo for therapeutic purposes and in vitro. Those of ordinary skill in the art will well know how to employ the PRO724 polypeptides of the present invention for such purposes.

PRO772 polypeptides of the present invention which possess biological activity related to that of the human A4 protein may be employed both in vivo for therapeutic purposes and in vitro. Those of ordinary skill in the art will well know how to employ the PRO772 polypeptides of the present invention for such purposes.

PRO852 polypeptides of the present invention which possess biological activity related to that of certain protease protein may be employed both in vivo for therapeutic purposes and in vitro. Those of ordinary skill in the art will well know how to employ the PRO852 polypeptides of the present invention for such purposes.

PRO853 polypeptides of the present invention which possess biological activity related to that of the reductase protein may be employed both in vivo for therapeutic purposes and in vitro. Those of ordinary skill in the art will well know how to employ the PRO853 polypeptides of the present invention for such purposes.

PRO853 polypeptides and portions thereof which have homology to reductase proteins may also be useful for in vivo therapeutic purposes, as well as for various other applications. Given that oxygen free radicals and antioxidants appear to play important roles in a number of disease processes, the identification of new reductase proteins and reductase-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO853.

PRO860 polypeptides of the present invention which possess biological activity related to that of the neurofascin protein may be employed both in vivo for therapeutic purposes and in vitro. Those of ordinary skill in the art will well know how to employ the PRO860 polypeptides of the present invention for such purposes.

PRO860 polypeptides and portions thereof which have homology to neurofascin may also be useful for in vivo therapeutic purposes, as well as for various other applications. The identification of novel neurofascin proteins and related molecules may be relevant to a number of human disorders which involve cellular adhesion. Thus, the identification of new neurofascin proteins and neurofascin protein-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO860.

PRO846 polypeptides of the present invention which possess biological activity related to that of the CMRF35 protein may be employed both in vivo for therapeutic purposes and in vitro. Those of ordinary skill in the art will well know how to employ the PRO846 polypeptides of the present invention for such purposes.

PRO846 polypeptides and portions thereof which have homology to the CMRF35 protein may also be useful for in vivo therapeutic purposes, as well as for various other applications. The identification of novel CMRF35 protein and related molecules may be relevant to a number of human disorders. Thus, the identification of new CMRF35 protein and CMRF35 protein-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO846.

PRO862 polypeptides of the present invention which possess biological activity related to that of the lysozyme protein may be employed both in vivo for therapeutic purposes and in vitro. Those of ordinary skill in the art will well know how to employ the PRO862 polypeptides of the present invention for such purposes.

PRO862 polypeptides and portions thereof which have homology to the lysozyme protein may also be useful for in vivo therapeutic purposes, as well as for various other applications. The identification of novel lysozyme proteins and related molecules may be relevant to a number of human disorders. Thus, the identification of new lysozymes and lysozyme-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO862.

PRO864 polypeptides of the present invention which possess biological activity related to that of the Wnt-4 protein may be employed both in vivo for therapeutic purposes and in vitro. Those of ordinary skill in the art will well know how to employ the PRO864 polypeptides of the present invention for such purposes.

PRO864 polypeptides and portions thereof which have homology to the Wnt-4 protein may also be useful for in vivo therapeutic purposes, as well as for various other applications. The identification of novel Wnt-4 proteins and related molecules may be relevant to a number of human disorders. Thus, the identification of new Wnt-4 protein and Wnt-4 protein-like molecules is of special importance in that such proteins may serve as potential therapeutics for a variety of different human disorders. Such polypeptides may also play important roles in biotechnological and medical research as well as various industrial applications. As a result, there is particular scientific and medical interest in new molecules, such as PRO864.

PRO792 polypeptides of the present invention which possess biological activity related to that of the CD23 protein may be employed both in vivo for therapeutic purposes and in vitro. Those of ordinary skill in the art will well know how to employ the PRO792 polypeptides of the present invention for such purposes.

PRO866 polypeptides of the present invention which possess biological activity related to that of mindin and/or spondin protein may be employed both in vivo for therapeutic purposes and in vitro. Those of ordinary skill in the art will well know how to employ the PRO866 polypeptides of the present invention for such purposes.

PRO871 polypeptides of the present invention which possess biological activity related to that of the cyclophilin protein family may be employed both in vivo for therapeutic purposes and in vitro. Those of ordinary skill in the art will well know how to employ the PRO871 polypeptides of the present invention for such purposes.

PRO873 polypeptides of the present invention which possess biological activity related to that of carboxylesterases may be employed both in vivo for therapeutic purposes and in vitro. For example, they be used in conjunction with prodrugs to convert the prodrug to its active form (see Danks et al., supra). They may be used to inhibit parasite infection (see van Pelt et al, supra). Methods for employ the PRO873 polypeptides of the present invention for these, and other purposes will be readily apparent to those of ordinary skill in the art.

PRO940 polypeptides of the present invention which possess biological activity related to that of the CD33 protein and/or OB binding protein-2 may be employed both in vivo for therapeutic purposes and in vitro. Those of ordinary skill in the art will well know how to employ the PRO940 polypeptides of the present invention for such purposes.

PRO941 polypeptides of the present invention which possess biological activity related to that of a cadherin protein may be employed both in vivo for therapeutic purposes and in vitro. Those of ordinary skill in the art will well know how to employ the PRO941 polypeptides of the present invention for such purposes.

PRO944 polypeptides of the present invention which possess biological activity related to that of the CPE-R protein may be employed both in vivo for therapeutic purposes and in vitro. Those of ordinary skill in the art will well know how to employ the PRO944 polypeptides of the present invention for such purposes. PRO944 polypeptides of the present invention that function to bind to Clostridium perfringens enterotoxin (CPE) may find use for effectively treating infection by the CPE endotoxin.

PRO983 polypeptides of the present invention which possess biological activity related to that of the vesicle-associated membrane protein, VAP-33, may be employed both in vivo for therapeutic purposes and in vitro. Those of ordinary skill in the art will well know how to employ the PRO983 polypeptides of the present invention for such purposes.

PRO1057 polypeptides of the present invention which possess biological activity related to that of protease proteins may be employed both in vivo for therapeutic purposes and in vitro. Those of ordinary skill in the art will well know how to employ the PRO1057 polypeptides of the present invention for such purposes.

PRO1071 polypeptides of the present invention which possess biological activity related to that of the thrombospondin protein may be employed both in vivo for therapeutic purposes and in vitro. Those of ordinary skill in the art will well know how to employ the PRO1071 polypeptides of the present invention for such purposes.

PRO1072 polypeptides of the present invention which possess biological activity related to that of reductase proteins may be employed both in vivo for therapeutic purposes and in vitro. Those of ordinary skill in the art will well know how to employ the PRO1072 polypeptides of the present invention for such purposes.

PRO1075 polypeptides of the present invention which possess biological activity related to that of protein disulfide isomerase may be employed both in vivo for therapeutic purposes and in vitro. Those of ordinary skill in the art will well know how to employ the PRO 1075 polypeptides of the present invention for such purposes.

PRO181 polypeptides of the present invention which possess biological activity related to that of the cornichon protein may be employed both in vivo for therapeutic purposes and in vitro. Those of ordinary skill in the art will well know how to employ the PRO181 polypeptides of the present invention for such purposes.

PRO827 polypeptides of the present invention which possess biological activity related to that of various integrin proteins may be employed both in vivo for therapeutic purposes and in vitro. Those of ordinary skill in the art will well know how to employ the PRO827 polypeptides of the present invention for such purposes.

PRO1114 polypeptides of the present invention which possess biological activity related to that of the cytokine receptor family of proteins may be employed both in vivo for therapeutic purposes and in vitro. Those of ordinary skill in the art will well know how to employ the PRO1114 polypeptides of the present invention for such purposes.

In addition to the above, the PRO1114 interferon receptor polypeptides may be employed in applications, both in vivo and in vitro, where the ability to bind to an interferon ligand is desired. Such applications will be well within the skill level in the art.

PRO237 polypeptides of the present invention which possess biological activity related to that of the carbonic anhydrase protein may be employed both in vivo for therapeutic purposes and in vitro. Those of ordinary skill in the art will well know how to employ the PRO237 polypeptides of the present invention for such purposes.

PRO541 polypeptides of the present invention which possess biological activity related to that of a trypsin inhibitor protein may be employed both in vivo for therapeutic purposes and in vitro. Those of ordinary skill in the art will well know how to employ the PRO541 polypeptides of the present invention for such purposes.

PRO273 polypeptides can be used in assays that other chemokines would be used in to perform comparative assays. The results can be used accordingly.

PRO701 polypeptides of the present invention which possess biological activity related to that of the neuroligin family may be employed both in vivo for therapeutic purposes and in vitro. Those of ordinary skill in the art will well know how to employ the PRO701 polypeptides of the present invention for such purposes.

PRO701 can be used in assays with neurons and its activity thereon can be compared with that of neuroligins 1, 2 and 3. The results can be applied accordingly.

PRO704 polypeptides of the present invention which possess biological activity related to that of vesicular integral membrane proteins may be employed both in vivo for therapeutic purposes and in vitro. Those of ordinary skill in the art will well know how to employ the PRO704 polypeptides of the present invention for such purposes.

PRO704 can be used in assays with the polypeptides to which they have identity with to determine the relative activities. The results can be applied accordingly. PRO704 can be tagged or measured for activity to measure endocytosis activity and thereby used to screen for agents which effect endocytosis.

PRO706 polypeptides of the present invention which possess biological activity related to that of the endogenous prostatic acid phosphatase precursor may be employed both in vivo for therapeutic purposes and in vitro. Those of ordinary skill in the art will well know how to employ the PRO706 polypeptides of the present invention for such purposes.

PRO706 can be used in assays with human prostatic acid phosphatase or human lysosomal acid phosphatase and its activity thereon can be compared with that of human prostatic acid phosphatase or human lysosomal acid phosphatase. The results can be applied accordingly.

PRO707 polypeptides of the present invention which possess biological activity related to that of cadherins may be employed both in vivo for therapeutic purposes and in vitro. Those of ordinary skill in the art will well know how to employ the PRO707 polypeptides of the present invention for such purposes.

PRO707 can be used in assays to determine its activity in relation to other cadherins, particularly cadherin FIB3. The results can be applied accordingly.

PRO322 polypeptides of the present invention which possess biological activity related to that of neuropsin may be employed both in vivo for therapeutic purposes and in vitro. Those of ordinary skill in the art will well know how to employ the PRO322 polypeptides of the present invention for such purposes.

PRO322 can be used in assays to determine its activity relative to neuropsin, trypsinogen, serine protease and neurosin, and the results applied accordingly.

PRO526 polypeptides of the present invention which possess biological activity related to that of protein-protein binding proteins may be employed both in vivo for therapeutic purposes and in vitro. Those of ordinary skill in the art will well know how to employ the PRO526 polypeptides of the present invention for such purposes.

Assays can be performed with growth factors and other proteins which are known to form complexes to determine whether PRO526 binds thereto and whether there is increased half-life due to such binding. The results can be used accordingly.

PRO531 polypeptides of the present invention which possess biological activity related to that of the protocadherins may be employed both in vivo for therapeutic purposes and in vitro. Those of ordinary skill in the art will well know how to employ the PRO531 polypeptides of the present invention for such purposes.

PRO531 can be used in assays against protocadherin 3 and other protocadherins, to determine their relative activities. The results can be applied accordingly.

PRO534 polypeptides of the present invention which possess biological activity related to that of the protein disulfide isomerase may be employed both in vivo for therapeutic purposes and in vitro. Those of ordinary skill in the art will well know how to employ the PRO534 polypeptides of the present invention for such purposes.

PRO534 can be used in assays with protein disulfide isomerase to determine the relative activities. The results can be applied accordingly.

PRO697 polypeptides of the present invention which possess biological activity related to that of the sFRP family may be employed both in vivo for therapeutic purposes and in vitro. Those of ordinary skill in the art will well know how to employ the PRO697 polypeptides of the present invention for such purposes.

PRO697 can be used in assays with sFRPs and SARPs to determine the relative activities. The results can be applied accordingly.

PRO731 polypeptides of the present invention which possess biological activity related to that of any protocadherin may be employed both in vivo for therapeutic purposes and in vitro. Those of ordinary skill in the art will well know how to employ the PRO731 polypeptides of the present invention for such purposes.

PRO731 can be used in assays with the polypeptides to which they have identity with to determine the relative activities. The results can be applied accordingly.

PRO768 polypeptides of the present invention which possess biological activity related to that of integrins may be employed both in vivo for therapeutic purposes and in vitro. Those of ordinary skill in the art will well know how to employ the PRO768 polypeptides of the present invention for such purposes.

PRO768 can be used in assays with the polypeptides to which they have identity with to determine the relative activities. The results can be applied accordingly.

PRO771 polypeptides of the present invention which possess biological activity related to that of the testican protein may be employed both in vivo for therapeutic purposes and in vitro. Those of ordinary skill in the art will well know how to employ the PRO771 polypeptides of the present invention for such purposes.

PRO771 can be used in assays with the polypeptides to which they have identity with to determine the relative activities. The results can be applied accordingly.

PRO733 polypeptides of the present invention which possess biological activity related to that of the proteins which bind the T1/ST2 receptor may be employed both in vivo for therapeutic purposes and in vitro. Those of ordinary skill in the art will well know how to employ the PRO733 polypeptides of the present invention for such purposes.

PRO733 can be used in assays with the polypeptides to which they have identity with to determine the relative activities. The results can be applied accordingly.

PRO162 polypeptides of the present invention which possess biological activity related to that of the pancreatitis-associated protein may be employed both in vivo for therapeutic purposes and in vitro. Those of ordinary skill in the art will well know how to employ the PRO162 polypeptides of the present invention for such purposes.

PRO162 can be used in assays with the polypeptides to which they have identity with to determine the relative activities. The results can be applied accordingly.

PRO788 polypeptides of the present invention which possess biological activity related to that of the anti-neoplastic urinary protein may be employed both in vivo for therapeutic purposes and in vitro. Those of ordinary skill in the art will well know how to employ the PRO788 polypeptides of the present invention for such purposes.

PRO788 can be used in assays with the polypeptides to which they have identity with to determine the relative activities. The results can be applied accordingly.

PRO1008 polypeptides of the present invention which possess biological activity related to that of dkk-1 may be employed both in vivo for therapeutic purposes and in vitro. Those of ordinary skill in the art will well know how to employ the PRO1008 polypeptides of the present invention for such purposes.

PRO1008 can be used in assays with the polypeptides to which they have identity with to determine the relative activities. The results can be applied accordingly.

PRO1012 polypeptides of the present invention which possess biological activity related to that of the protein disulfide isomerase may be employed both in vivo and in vitro purposes. Those of ordinary skill in the art will well know how to employ the PRO1012 polypeptides of the present invention for such purposes.

PRO1012 can be used in assays with the polypeptides to which they have identity with to determine the relative activities. The results can be applied accordingly.

PRO1014 polypeptides of the present invention which possess biological activity related to that of reductase may be employed both in vivo for therapeutic purposes and in vitro. Those of ordinary skill in the art will well know how to employ the PRO1014 polypeptides of the present invention for such purposes.

PRO1014 can be used in assays with the polypeptides to which they have identity with to determine the relative activities. Inhibitors of PRO1014 are particularly preferred. The results can be applied accordingly.

PRO1017 polypeptides of the present invention which possess biological activity related to that of sulfotransferase may be employed both in vivo for therapeutic purposes and in vitro. Those of ordinary skill in the art will well know how to employ the PRO1017 polypeptides of the present invention for such purposes.

PRO1017 can be used in assays with the polypeptides to which they have identity with to determine the relative activities. The results can be applied accordingly.

PRO474 polypeptides of the present invention which possess biological activity related to that of dehydrogenase may be employed both in vivo for therapeutic purposes and in vitro. Those of ordinary skill in the art will well know how to employ the PRO474 polypeptides of the present invention for such purposes.

PRO474 can be used in assays with the polypeptides to which they have identity with to determine the relative activities. The results can be applied accordingly.

PRO1031 polypeptides of the present invention which possess biological activity related to that of IL-17 may be employed both in vivo for therapeutic purposes and in vitro. Those of ordinary skill in the art will well know how to employ the PRO1031 polypeptides of the present invention for such purposes.

PRO1031 can be used in assays with the polypeptides to which they have identity with to determine the relative activities. The results can be applied accordingly.

PRO938 polypeptides of the present invention which possess biological activity related to that of protein disulfide isomerase may be employed both in vivo for therapeutic purposes and in vitro. Those of ordinary skill in the art will well know how to employ the PRO938 polypeptides of the present invention for such purposes.

PRO1082 polypeptides of the present invention which possess biological activity related to that of the LDL receptor may be employed both in vivo for therapeutic purposes and in vitro. Those of ordinary skill in the art will well know how to employ the PRO1082 polypeptides of the present invention for such purposes.

PRO1082 can be used in assays with the polypeptides to which they have identity with to determine the relative activities. The results can be applied accordingly. PRO1082 can also be used in assays to identify candidate agents which modulate the receptors.

PRO1083 polypeptides of the present invention which possess biological activity related to that of 7 TM receptors may be employed both in vivo for therapeutic purposes and in vitro. Those of ordinary skill in the art will well know how to employ the PRO1083 polypeptides of the present invention for such purposes.

In particular PRO1083 can be used in assays to determine candidate agents which control or modulate PRO1083, i.e., have an effect on the receptor.

The VEGF-E molecules herein have a number of therapeutic uses associated with survival, proliferation and/or differention of cells. Such uses include the treatment of umbilical vein endothelial cells, in view of the demonstrated ability of VEGF-E to increase survival of human umbilical vein endothelial cells. Treatment may be needed if the vein were subjected to traumata, or situations wherein artificial means are employed to enhance the survival of the umbilical vein, for example, where it is weak, diseased, based on an artificial matrix, or in an artificial environment. Other physiological conditions that could be improved based on the selective mitogenic character of VEGF-E are also included herein. Uses also include the treatment of fibroblasts and myocytes, in view of the demonstrated ability of VEGF-E to induce proliferation of fibroblasts and hypertrophy in myocytes. In particular, VEGF-E can be used in wound healing, tissue growth and muscle generation and regeneration.

For the indications referred to above, the VEGF-E molecule will be formulated and dosed in a fashion consistent with good medical practice taking into account the specific disorder to be treated, the condition of the individual patient, the site of delivery of the VEGF-E, the method of administration, and other factors known to practitioners. Thus, for purposes herein, the "therapeutically effective amount" of the VEGF-E is an amount that is effective either to prevent, lessen the worsening of, alleviate, or cure the treated condition, in particular that amount which is sufficient to enhance the survival, proliferation and/or differentiation of the treated cells in vivo.

VEGF-E amino acid variant sequences and derivatives that are immunologically crossreactive with antibodies raised against native VEGF are useful in immunoassays for VEGF-E as standards, or, when labeled, as competitive reagents.

The VEGF-E is prepared for storage or administration by mixing VEGF-E having the desired degree of purity with physiologically acceptable carriers, excipients, or stabilizers. Such materials are non-toxic to recipients at the dosages and concentrations employed. If the VEGF-E is water soluble, it may be formulated in a buffer such as phosphate or other organic acid salt preferably at a pH of about 7 to 8. If the VEGF-E is only partially soluble in water, it may be prepared as a microemulsion by formulating it with a nonionic surfactant such as Tween, Pluronics, or PEG, e.g., Tween 80, in an amount of 0.04–0.05% (w/v), to increase its solubility.

Optionally other ingredients may be added such as antioxidants, e.g., ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, mannose, or dextrins; chelating agents such as EDTA; and sugar alcohols such as mannitol or sorbitol.

The VEGF-E to be used for therapeutic administration must be sterile. Sterility is readily accomplished by filtration through sterile filtration membranes (e.g., 0.2 micron membranes). The VEGF-E ordinarily will be stored in lyophilized form or as an aqueous solution if it is highly stable to thermal and oxidative denaturation. The pH of the VEGF-E preparations typically will be about from 6 to 8, although higher or lower pH values may also be appropriate in certain instances. It will be understood that use of certain of the foregoing excipients, carriers, or stabilizers will result in the formation of salts of the VEGF-E.

If the VEGF-E is to be used parenterally, therapeutic compositions containing the VEGF-E generally are placed into a container having a sterile access port, for example, an intravenous solution bag or vial having a stopper pierceable by a hypodermic injection needle.

Generally, where the disorder permits, one should formulate and dose the VEGF-E for site-specific delivery. This is convenient in the case of wounds and ulcers. Sustained release formulations may also be prepared, and include the formation of microcapsular particles and implantable articles. For preparing sustained-release VEGF-E compositions, the VEGF-E is preferably incorporated into a biodegradable matrix or microcapsule. A suitable material for this purpose is a polylactide, although other polymers of poly-(a-hydroxyearboxylic acids), such as poly-D-(−)-3-hydroxybutyric acid (EP 133,988A), can be used. Other biodegradable polymers include poly(lactones), poly(acetals), poly (orthoesters), or poly(orthocarbonates). The initial consideration here must be that the carrier itself, or its degradation products, is nontoxic in the target tissue and will not further aggravate the condition. This can be determined by routine screening in animal models of the target disorder or, if such models are unavailable, in normal animals. Numerous scientific publications document such animal models.

For examples of sustained release compositions, see U.S. Pat. No. 3,773,919, EP 58,481A, U.S. Pat. No. 3,887,699, EP 158,277A, Canadian Patent No. 1176565, U. Sidman et al., *Biopotymers* 22, 547 [1983], and R. Langer et al., *Chem. Tech.* 12, 98 [1982].

When applied topically, the VEGF-E is suitably combined with other ingredients, such as carriers and/or adjuvants. There are no limitations on the nature of such other ingredients, except that they must be pharmaceutically acceptable and efficacious for their intended administration, and cannot degrade the activity of the active ingredients of the composition. Examples of suitable vehicles include ointments, creams, gels, or suspensions, with or without purified collagen. The compositions also may be impregnated into transdermal patches, plasters, and bandages, preferably in liquid or semi-liquid form.

For obtaining a gel formulation, the VEGF-E formulated in a liquid composition may be mixed with an effective amount of a water-soluble polysaccharide or synthetic polymer such as polyethylene glycol to form a gel of the proper viscosity to be applied topically. The polysaccharide that may be used includes, for example, cellulose derivatives such as etherified cellulose derivatives, including alkyl celluloses, hydroxyalkyl celluloses, and alkylhydroxyalkyl celluloses, for example, methylcellulose, hydroxyethyl cellulose, carboxymethyl cellulose, hydroxypropyl methylcellulose, and hydroxypropyl cellulose; starch and fractionated starch; agar; alginic acid and alginates; gum arabic; pullullan; agarose; carrageenan; dextrans; dextrins; fructans; inulin; mannans; xylans; arabinans; chitosans; glycogens; glucans; and synthetic biopolymers; as well as gums such as xanthan gum; guar gum; locust bean gum; gum arabic; tragacanth gum; and karaya gum; and derivatives and mixtures thereof. The preferred gelling agent herein is one that is inert to biological systems, nontoxic, simple to prepare, and not too runny or viscous, and will not destabilize the VEGF-E held within it.

Preferably the polysaccharide is an etherified cellulose derivative, more preferably one that is well defined, purified, and listed in USP, e.g., methylcellulose and the hydroxyalkyl cellulose derivatives, such as hydroxypropyl cellulose, hydroxyethyl cellulose, and hydroxypropyl methylcellulose. Most preferred herein is methylcellulose.

The polyethylene glycol useful for gelling is typically a mixture of low and high molecular weight polyethylene glycols to obtain the proper viscosity. For example, a mixture of a polyethylene glycol of molecular weight 400–600 with one of molecular weight 1500 would be effective for this purpose when mixed in the proper ratio to obtain a paste.

The term “water soluble” as applied to the polysaccharides and polyethylene glycols is meant to include colloidal solutions and dispersions. In general, the solubility of the cellulose derivatives is determined by the degree of substitution of ether groups, and the stabilizing derivatives useful herein should have a sufficient quantity of such ether groups per anhydroglucose unit in the cellulose chain to render the derivatives water soluble. A degree of ether substitution of at least 0.35 ether groups per anhydroglucose unit is generally sufficient. Additionally, the cellulose derivatives may be in the form of alkali metal salts, for example, the Li, Na, K, or Cs salts.

If methylcellulose is employed in the gel, preferably it comprises about 2–5%, more preferably about 3%, of the gel and the VEGF is present in an amount of about 300–1000 mg per ml of gel.

The dosage to be employed is dependent upon the factors described above. As a general proposition, the VEGF-E is formulated and delivered to the target site or tissue at a dosage capable of establishing in the tissue a VEGF-E level greater than about 0.1 ng/cc up to a maximum dose that is efficacious but not unduly toxic. This intra-tissue concentration should be maintained if possible by continuous infusion, sustained release, topical application, or injection at empirically determined frequencies.

It is within the scope hereof to combine the VEGF-E therapy with other novel or conventional therapies (e.g., growth factors such as VEGF, aFGF, bFGF, PDGF, IGF, NGF, anabolic steroids, EGF or TGF-a) for enhancing the activity of any of the growth factors, including VEGF-E, in promoting cell proliferation, survival, differentiation and repair. It is not necessary that such cotreatment drugs be included per se in the compositions of this invention, although this will be convenient where such drugs are proteinaceous. Such admixtures are suitably administered in the same manner and for the same purposes as the VEGF-E used alone. The useful molar ratio of VEGF-E to such secondary growth factors is typically 1:0.1–10, with about equimolar amounts being preferred.

The compounds of the present invention can be formulated according to known methods to prepare pharmaceutically useful compositions, whereby the PRO polypeptide hereof is combined in admixture with a pharmaceutically acceptable carrier vehicle. Suitable carrier vehicles and their formulation, inclusive of other human proteins, e.g., human serum albumin, are described, for example, in *Remington's Pharmaceutical Sciences*, 16th ed., 1980, Mack Publishing Co., edited by Oslo et al. the disclosure of which is hereby incorporated by reference. The VEGF-E herein may be administered parenterally to subjects suffering from cardiovascular diseases or conditions, or by other methods that ensure its delivery to the bloodstream in an effective form.

Compositions particularly well suited for the clinical administration of VEGF-E hereof employed in the practice of the present invention include, for example, sterile aqueous solutions, or sterile hydratable powders such as lyophilized protein. It is generally desirable to include further in the formulation an appropriate amount of a pharmaceutically acceptable salt, generally in an amount sufficient to render the formulation isotonic. A pH regulator such as arginine base, and phosphoric acid, are also typically included in sufficient quantities to maintain an appropriate pH, generally from 5.5 to 7.5. Moreover, for improvement of shelf-life or stability of aqueous formulations, it may also be desirable to include further agents such as glycerol. In this manner, variant t-PA formulations are rendered appropriate for parenteral administration, and, in particular, intravenous administration.

Dosages and desired drug concentrations of pharmaceutical compositions of the present invention may vary depending on the particular use envisioned. For example, in the treatment of deep vein thrombosis or peripheral vascular disease, "bolus" doses, will typically be preferred with subsequent administrations being given to maintain an approximately constant blood level, preferably on the order of about 3 µg/ml.

However, for use in connection with emergency medical care facilities where infusion capability is generally not available and due to the generally critical nature of the underlying disease (e.g., embolism, infarct), it will generally be desirable to provide somewhat larger initial doses, such as an intravenous bolus.

For the various therapeutic indications referred to for the compounds hereof, the VEGF-E molecules will be formulated and dosed in a fashion consistent with good medical practice taking into account the specific disorder to be treated, the condition of the individual patient, the site of delivery, the method of administration and other factors known to practitioners in the respective art. Thus, for purposes herein, the "therapeutically effective amount" of the VEGF-E molecules hereof is an amount that is effective either to prevent, lessen the worsening of, alleviate, or cure the treated condition, in particular that amount which is sufficient to enhance the survival, proliferation or differentiation of targeted cells in vivo. In general a dosage is employed capable of establishing in the tissue that is the target for the therapeutic indication being treated a level of a VEGF-E hereof greater than about 0.1 ng/cm$^3$ up to a maximum dose that is efficacious but not unduly toxic. It is contemplated that intra-tissue administration may be the choice for certain of the therapeutic indications for the compounds hereof.

The human Toll proteins of the present invention can also be used in assays to identify other proteins or molecules involved in Toll-mediated signal transduction. For example, PRO285 and PRO286 are useful in identifying the as of yet unknown natural ligands of human Tolls, or other factors that participate (directly or indirectly) in the activation of and/or signaling through a human Toll receptor, such as potential Toll receptor associated kinases. In addition, inhibitors of the receptor/ligand binding interaction can be identified. Proteins involved in such binding interactions can also be used to screen for peptide or small molecule inhibitors or agonists of the binding interaction. Screening assays can be designed to find lead compounds that mimic the biological activity of a native Toll polypeptide or a ligand for a native Toll polypeptide. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

In vitro assays employ a mixture of components including a Toll receptor polypeptide, which may be part of fusion product with another peptide or polypeptide, e.g., a tag for detecting or anchoring, etc. The assay mixtures may further comprise (for binding assays) a natural intra- or extracellular Toll binding target (i.e. a Toll ligand, or another molecule known to activate and/or signal through the Toll receptor). While native binding targets may be used, it is frequently preferred to use portion of such native binding targets (e.g. peptides), so long as the portion provides binding affinity and avidity to the subject Toll protein conveniently measurable in the assay. The assay mixture also contains a candidate pharmacological agent. Candidate agents encompass numerous chemical classes, through typically they are organic compounds, preferably small organic compounds, and are obtained from a wide variety of sources, including libraries of synthetic or natural compounds. A variety of other reagents may also be included in the mixture, such as, salts, buffers, neutral proteins, e.g. albumin, detergents, protease inhibitors, nuclease inhibitors, antimicrobial agents, etc.

In in vitro binding assays, the resultant mixture is incubated under conditions whereby, but for the presence of the candidate molecule, the Toll protein specifically binds the cellular binding target, portion or analog, with a reference binding affinity. The mixture components can be added in any order that provides for the requisite bindings and incubations may be performed at any temperature which facilitates optimal binding. Incubation periods are likewise selected for optimal binding but also minimized to facilitate rapid high-throughput screening.

After incubation, the agent-biased binding between the Toll protein and one or more binding targets is detected by any convenient technique. For cell-free binding type assays, a separation step is often used to separate bound from unbound components. Separation may be effected by precipitation (e.g. TCA precipitation, immunoprecipitation, etc.), immobilization (e.g on a solid substrate), etc., followed by washing by, for example, membrane filtration (e.g. Whatman's P-18 ion exchange paper, Polyfiltronic's hydrophobic GFC membrane, etc.), gel chromatography (e.g. gel filtration, affinity, etc.). For Toll-dependent transcription assays, binding is detected by a change in the expression of a Toll-dependent reporter.

Detection may be effected in any convenient way. For cell-free binding assays, one of the components usually comprises or is coupled to a label. The label may provide for direct detection as radioactivity, luminescence, optical or electron density, etc., or indirect detection, such as, an epitope tag, an enzyme, etc. A variety of methods may be used to detect the label depending on the nature of the label and other assay components, e.g. through optical or electron density, radiative emissions, nonradiative energy transfers, etc. or indirectly detected with antibody conjugates, etc.

Nucleic acid encoding the Toll polypeptides disclosed herein may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., *Proc. Natl. Acad. Sci. USA* 83 4143–4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11, 205–210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262, 4429–4432 (1987); and Wagner et al., *Proc. Natl. Acad. Sci. USA* 87 , 3410–3414 (1990). For review of the currently known gene marking and gene therapy protocols see Anderson et al., *Science* 256, 808–813 (1992).

The various uses listed in connection with the Toll proteins herein, are also available for agonists of the native Toll receptors, which mimic at least one biological function of a native Toll receptor.

Neurotrimin as well as other members of the IgLON subfamily of the immunoglobulin superfamily have been identified to have effect upon neural patterning, differentiation, maturation and growth. As a result, PRO337 the human neurotrimin homolog polypeptides would be expected to have utility in diseases which are characterized by neural disfunction. For example, motoneuron disorders such as amyotrophic lateral sclerosis (Lou Gehrig's disease), Bell's palsy, and various conditions involving spinal muscular atrophy, or paralysis. NGF variant formulations of the invention can be used to treat human neurodegenerative disorders, such as Alzheimer's disease, Parkinson's disease, epilepsy, multiple sclerosis, Huntington's chorea, Down's Syndrome, nerve deafness, and Meniere's disease. Moreover PRO337 polypeptide may also be used as a cognitive enhancer, to enhance learning particularly in dementia or trauma, such as those associated with the above diseases.

Further, PRO337 may be employed to treat neuropathy, and especially peripheral neuropathy. "Peripheral neuropathy" refers to a disorder affecting the peripheral nervous system, most often manifested as one or a combination of motor, sensory, sensorimotor, or autonomic neural dysfunction. The wide variety of morphologies exhibited by peripheral neuropathies can each be attributed uniquely to an equally wide number of causes. For example, peripheral neuropathies can be genetically acquired, can result from a systemic disease, or can be induced by a toxic agent. Examples include but are not limited to diabetic peripheral neuropathy, distal sensorimotor neuropathy, or autonomic neuropathies such as reduced motility of the gastrointestinal tract or atony of the urinary bladder. Examples of neuropathies associated with systemic disease include post-polio syndrome or AIDS-associated neuropathy; examples of hereditary neuropathies include Charcot-Marie-Tooth disease, Refsum's disease, Abetalipoproteinemia, Tangier disease, Krabbe's disease, Metachromatic leukodystrophy, Fabry's disease, and Dejerine-Sottas syndrome; and examples of neuropathies caused by a toxic agent include those caused by treatment with a chemotherapeutic agent such as vincristine, cisplatin, methotrexate, or 3'-azido-3'-deoxythymidine. Correspondingly, neurotrimin antagonists would be expected to have utility in diseases characterized by excessive neuronal activity.

Endothelin is generated from inactive intermediates, the big endothelins, by a unique processing event catalyzed by the zinc metalloprotease, endothelin converting enzyme (ECE). ECE was recently cloned, and its structure was shown to be a single pass transmembrane protein with a short intracellular N-terminal and a long extracellular C-terminal that contains the catalytic domain and numerous N-glycosylation sites. ECEs cleave the endothelin propeptide between Trp73 and Val74 producing the active peptide, ET, which appears to function as a local rather than a circulating hormone (Rubanyi, G. M. & Polokoff, M. A., Pharmachological Reviews 46: 325–415 (1994). Thus ECE activity is a potential site of regulation of endothelin production and a possible target for therapeutic intervention in the endothelin system. By blocking ECE activity, it is possible stop the production of ET-1 by inhibiting the conversion of the relatively inactive precursor, big ET-1, to the physiologically active form.

ECE-2 is 64% identical to bovine ECE-2 at the amino acid level. ECE-2 is closely related to ECE-1 (63% identical, 80% conserved), neutral endopeptidase 24.11 and the Kell blood group protein. Bovine ECE-2 is a type II membrane-bound metalloproteinase localized in the trans-Golgi network where it acts as an intracellular enzyme converting endogenous big endothelin-1 into active endothelin (Emoto, N. and Yanangisawa, M., J. Biol. Chem. 270: 15262–15268 (1995). The bovine ECE-2 mRNA expression is highest in parts of the brain, cerebral cortex, cerebellum and adrenal medulla. It is expressed at lower levels in mymetrium, testes, ovary, and endothelial cells. Bovine ECE-2 and ECE-1 both are more active on ET-1 as a substrate compared to ET-2 or ET-3, Emoto and Yanangisawa, supra. Human ECE-2 is 736 amino acids in length with a 31 residue amino-terminal tail, a 23 residue transmembrane helix and a 682 carboxy-terminal domain. It is 94% identical to bovine ECE-2 and 64% identical to human ECE-1. The predicted transmembrane domain is highly conserved between the human and bovine ECE-2 proteins and between human ECE-1 and human ECE-2, as are the putative N-linked glycosylation sites, Cys residues conserved in the neutral endopeptidase 24.11 and the Kell blood group protein family and the putative zinc binding motif. The sequence suggests, that like other members of the NEP-ECE-Kell family, human ECE-2 encodes a type II transmembrane zinc-binding metalloproteinase, which, by extrapolation from what is known about bovine ECE-2, is an intracellular enzyme located within the secretory pathway which processes endogenously produced big ET-1 while it is still in the secretory vesicles. Emoto and Yanangisawa, supra.

The expression pattern of ECE-2 differs from that observed for ECE-1. Northern blot analysis of mRNA levels indicated low levels of expression of a 3.3 kb transcript in adult brain (highest in the cerebellum, putamen, medulla and temporal lobe, and lower in the cerebral cortex, occipital lobe and frontal lobe), spinal cord, lung and pancreas and higher levels of a 4.5 kb transcript in fetal brain and kidney. The two transcript sizes probably represent the use of alternative polyadenylation sites as has been observed for bovine ECE-2 (Emoto and Yanangisawa, supra) and ECE-1 (Xu et al., Cell 78: 473–485 (1994). PCR on cDNA libraries indicated low levels of expression in fetal brain, fetal kidney, fetal small intestine and adult testis. Fetal liver, fetal lung and adult pancreas were all negative.

The endothelin (ET) family of peptides have potent vascular, cardiac and renal actions which may be of pathophysiological importance in many human disease states. ET-1 is expressed as an inactive 212 amino acid prepropeptide. The prepropeptide is first cleaved at Arg52–Cys53 and Arg92–Ala93 and then the carboxy terminal Lys91 and Arg92 are trimmed from the protein to generate the propeptide big ET-1. ECEs then cleave the propeptide between Trp73 and Val74, producing the active peptide, ET, which appears to function as a local rather than a circulating hormone (Rubanyi and Polokoff, Pharma. R. 46: 325–415 (1994).

Endothelins may play roles in the pathophysiology of a number of disease states including: 1) cardiovascular diseases (vasospasm, hypertension, myocardial ischemia; reperfusion injury and acute myochardial infarction, stroke (cerebral ischemia), congestive heart failure, shock, atherosclerosis, vascular thickening); 2) kidney disease (acute and chronic renal failure, glomerulonephritis, cirrhosis); 3) lung disease (bronchial asthma, pulmonary hypertension); 4) gastrointestinal disorders (gastric ulcer, inflammatory bowel diseases); 5) reproductive disorders (premature labor, dysmenorhea, preeclampsia) and 6) carcinogenesis. Rubanyi & Polokoff, supra.

Diseases can be evaluated for the impact of ET upon them by examining: 1) increased production of ETs; 2) increased reactivity to ETs; and/or 3) efficacy of an ET receptor antagonist, antibody or ECE inhibitor. Response to the previous criteria suggest that ETs likely play roles in cerebral vasospasm following subarachnoid hemorrhage, hypertension (fulminant/complications), acute renal failure and congestive heart failure. While inhibitors of ET production or activity have not been used in models of coronary vasospasm, acute myocardial infarction, and atherosclerosis, they do have elevated ET levels and increase reactivity to ETs. Shock and pulmonary hypertension also exhibit elevated ET levels (Rubanyi and Polokoff, supra). Inhibition of ECEs in these conditions may be of therapeutic value.

The expression pattern of ECE-2 differs from that observed for ECE-1. ECE-2 was observed at low levels in the adult brain, lung and pancreas and higher levels in fetal brain and kidney by Northern blot analysis (FIG. 8). PCR revealed low levels of expression in additional tissues: fetal lung, fetal small intestine and adult testis. Fetal liver was negative. A similar pattern was reported for bovine ECE-2 (Emoto and Yanangisawa, supra). It is expressed in brain tissues (cerebral cortex, cerebellum and adrenal medulla), myometrium and testis, and in low levels in ovary and very low levels in many other tissues. Bovine ECE-1 (Xu et al, supra) is more widely and more abundantly expressed. It is observed in vascular endothelial cells of most organs and in some parenchymal cells. With the exception for brain, bovine ECE-2 mRNA was present at lower levels than ECE-1. Applicants believe ECE-2 to be a particularly good target for the therapeutic intervention for diseases such as cerebral vasospasm following subarachnoid hemorrhage and stroke.

Uses of the herein disclosed molecules may also be based upon the positive functional assay hits disclosed and described below.

F. Anti-PRO Antibodies

The present invention further provides anti-PRO antibodies. Exemplary antibodies include polyclonal, monoclonal, humanized, bispecific, and heteroconjugate antibodies.

1. Polyclonal Antibodies

The anti-PRO antibodies may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

2. Monoclonal Antibodies

The anti-PRO antibodies may, alternatively, be monoclonal antibodies. Monoclonal antibodies may be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59–103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133:3001 (1984); Brodeur et al., *Monoclonal Antibody Production Techniques and Applications*, Marcel Dekker, Inc., New York, (1987) pp. 51–63].

The culture medium in which the hybridoma cells are cultured can then be assayed for the presence of monoclonal antibodies directed against PRO. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980).

After the desired hybridoma cells are identified, the clones may be subcloned by limiting dilution procedures and grown by standard methods [Goding, supra]. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences [U.S. Pat. No. 4,816,567; Morrison et al., supra] or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly, Fab fragments, can be accomplished using routine techniques known in the art.

3. Human and Humanized Antibodies

The anti-PRO antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature*, 321:522–525 (1986); Riechmann et al., *Nature*, 332:323–329 (1988); and Presta, *Curr. Op. Struct. Biol.*, 2:593–596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature*, 321:522–525 (1986); Riechmann et al., *Nature* 332:323–327 (1988); Verhoeyen et al., *Science*, 239:1534–1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, *J. Mol. Biol.*, 227:381 (1991); Marks et al., *J. Mol. Biol.*, 222:581 (1991)]. The techniques of Cole et al. and Boerner et al. are also available for the preparation of human monoclonal antibodies (Cole et al., *Monoclonal Antibodies and Cancer Therapy*, Alan R. Liss, p. 77 (1985) and Boerner et al., *J. Immunol.*, 147(1):86–95 (1991)]. Similarly, human antibodies can be made by introducing of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., *Bio/Technology* 10, 779–783 (1992); Lonberg et al., *Nature* 368 856–859 (1994); Morrison, *Nature* 368, 812–13 (1994); Fishwild et al., *Nature Biotechnology* 14, 845–51 (1996); Neuberger, *Nature Biotechnology* 14, 826 (1996); Lonberg and Huszar, *Intern. Rev. Immunol.* 13 65–93 (1995).

4. Bispecific Antibodies

Bispecific antibodies are monoclonal, preferably human or humanized, antibodies that have binding specificities for at least two different antigens. In the present case, one of the binding specificities is for the PRO, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities [Milstein and Cuello, *Nature*, 305:537–539 (1983)]. Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., *EMBO J.* 10:3655–3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology*, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared can be prepared using chemical linkage. Brennan et al., *Science* 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Fab' fragments may be directly recovered from *E. coli* and chemically coupled to form bispecific antibodies. Shalaby et al., *J. Exp. Med.* 175:217–225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various technique for making and isolating bispecific antibody fragments directly from recombinant cell culture have also been described. For example, bispecific antibodies have been produced using leucine zippers. Kostelny et al., *J. Immunol.* 148(5):1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immu-*

*nol.* 152:5368 (1994). Antibodies with more than two valencies are contemplated. For example, trispecific antibodies can be prepared. Tutt et al., *J. Immunol.* 147:60 (1991).

Exemplary bispecific antibodies may bind to two different epitopes on a given PRO polypeptide herein. Alternatively, an anti-PRO polypeptide arm may be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular PRO polypeptide. Bispecific antibodies may also be used to localize cytotoxic agents to cells which express a particular PRO polypeptide. These antibodies possess a PRO-binding arm and an arm which binds a cytotoxic agent or a radionuclide chelator, such as EOTUBE, DPTA, DOTA, or TETA. Another bispecific antibody of interest binds the PRO polypeptide and further binds tissue factor (TF).

5. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp Med.*, 176: 1191–1195 (1992) and Shopes, *J. Immunol.*, 148: 2918–2922 (1992). Homodimeric antibodies with enhanced anti-tumor activity may also be prepared using heterobifunctional cross-linkers as described in Wolff et al. *Cancer Research*, 53: 2560–2565 (1993). Alternatively, an antibody can be engineered that has dual Fc regions and may thereby have enhanced complement lysis and ADCC capabilities. See Stevenson et al., *Anti-Cancer Drug Design*, 3: 219–230 (1989).

7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4dinitrobenzene). For example, a ricin immunotoxin can be prepared as described in Vitetta et al., *Science,* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody may be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

8. Immunoliposomes

The antibodies disclosed herein may also be formulated as immunoliposomes. Liposomes containing the antibody are prepared by methods known in the art, such as described in Epstein et al., *Proc. Natl. Acad. Sci. USA,* 82: 3688 (1985); Hwang et al., *Proc. Natl Acad. Sci. USA,* 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al ., *J. Biol. Chem.,* 257: 286–288 (1982) via a disulfide-interchange reaction. A chemotherapeutic agent (such as Doxorubicin) is optionally contained within the liposome. See Gabizon et al., *J. National Cancer Inst.,* 81(19): 1484 (1989).

9. Pharmaceutical Compositions of Antibodies

Antibodies specifically binding a PRO polypeptide identified herein, as well as other molecules identified by the screening assays disclosed hereinbefore, can be administered for the treatment of various disorders in the form of pharmaceutical compositions.

If the PRO polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA,* 90: 7889–7893 (1993). The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles, and nanocapsules) or in macroemulsions. Such techniques are disclosed in Remington's *Pharmaceutical Sciences,* supra.

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(–)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

G. Uses for Anti-PRO Antibodies

The anti-PRO antibodies of the invention have various utilities. For example, anti-PRO antibodies may be used in diagnostic assays for PRO, e.g., detecting its expression in specific cells, tissues, or serum. Various diagnostic assay techniques known in the art may be used, such as competitive binding assays, direct or indirect sandwich assays and immunoprecipitation assays conducted in either heterogeneous or homogeneous phases [Zola, *Monoclonal Antibodies: A Manual of Techniques,* CRC Press, Inc. (1987) pp. 147–158]. The antibodies used in the diagnostic assays can be labeled with a detectable moiety. The detectable moiety should be capable of producing, either directly or indirectly, a detectable signal. For example, the detectable moiety may be a radioisotope, such as $^3H$, $^{14}C$, $^{32}P$, $^{35}S$, or $^{125}I$, a fluorescent or chemiluminescent compound, such as fluorescein isothiocyanate, rhodamine, or luciferin, or an enzyme, such as alkaline phosphatase, beta-galactosidase or horseradish peroxidase. Any method known in the art for conjugating the antibody to the detectable moiety may be employed, including those methods described by Hunter et al., *Nature,* 144:945 (1962); David et al., *Biochemistry,* 13:1014 (1974); Pain et al., *J. Immunol. Meth.,* 40:219 (1981); and Nygren, *J. Histochem. and Cytochem.,* 30:407 (1982).

Anti-PRO antibodies also are useful for the affinity purification of PRO from recombinant cell culture or natural sources. In this process, the antibodies against PRO are immobilied on a suitable support, such a Sephadex resin or filter paper, using methods well known in the art. The immobilized antibody then is contacted with a sample containing the PRO to be purified, and thereafter the support is washed with a suitable solvent that will remove substantially all the material in the sample except the PRO, which is bound to the immobilized antibody. Finally, the support is washed with another suitable solvent that will release the PRO from the antibody.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Rockville, Md.

Example 1

Extracellular Domain Homology Screening to Identify Novel Polypeptides and cDNA Encoding Therefor The extracellular domain (ECD) sequences (including the secretion signal sequence, if any) from about 950 known secreted proteins from the Swiss-Prot public database were used to search EST databases. The EST databases included public databases (e.g., Dayhoff, GenBank), and proprietary databases (e.g. LIFESEQ™, Incyte Pharmaceuticals, Palo Alto, Calif.). The search was performed using the computer program BLAST or BLAST2 (Altschul and Gish, *Methods in Enzymology* 266: 460–480 (1996)) as a comparison of the ECD protein sequences to a 6 frame translation of the EST sequences. Those comparisons with a Blast score of 70 (or in some cases 90) or greater that did not encode known proteins were clustered and assembled into consensus DNA sequences with the program "phrap" (Phil Green, University of Washington, Seattle, Wash.).

Using this extracellular domain homology screen, consensus DNA sequences were assembled relative to the other identified EST sequences using phrap. In addition, the consensus DNA sequences obtained were often (but not always) extended using repeated cycles of BLAST and phrap to extend the consensus sequence as far as possible using the sources of EST sequences discussed above.

Based upon the consensus sequences obtained as described above, oligonucleotides were then synthesized and used to identify by PCR a cDNA library that contained the sequence of interest and for use as probes to isolate a clone of the full-length coding sequence for a PRO polypeptide. Forward (.f) and reverse (.r) PCR primers generally range from 20 to 30 nucleotides and are often designed to give a PCR product of about 100–1000 bp in length. The probe (.p) sequences are typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

Example 2

Isolation of cDNA Clones by Amylase Screening

1. Preparation of Oligo dT Prime cDNA Library mRNA was isolated from a human tissue of interest using reagents and protocols from Invitrogen, San Diego, Calif. (Fast Track 2). This RNA was used to generate an oligo dT primed cDNA library in the vector pRK5D using reagents and protocols from Life Technologies, Gaithersburg, Md. (Super Script Plasmid System). In this procedure, the double stranded cDNA was sized to greater than 1000 bp and the SalI/NotI linkered cDNA was cloned into XhoI/NotI cleaved vector. pRK5D is a cloning vector that has an sp6 transcription initiation site followed by an SfiI restriction enzyme site preceding the XhoI/NotI cDNA cloning sites.

2. Preparation of Random Primed cDNA Library

A secondary cDNA library was generated in order to preferentially represent the 5' ends of the primary cDNA clones. Sp6 RNA was generated from the primary library (described above), and this RNA was used to generate a random primed cDNA library in the vector pSST-AMY.0 using reagents and protocols from Life Technologies (Super Script Plasmid System, referenced above). In this procedure the double stranded cDNA was sized to 500–1000 bp, linkered with blunt to NotI adaptors, cleaved with SfiI, and cloned into SfiI/NotI cleaved vector. pSST-AMY.0 is a cloning vector that has a yeast alcohol dehydrogenase promoter preceding the cDNA cloning sites and the mouse amylase sequence (the mature sequence without the secretion signal) followed by the yeast alcohol dehydrogenase terminator, after the cloning sites. Thus, cDNAs cloned into this vector that are fused in frame with amylase sequence will lead to the secretion of amylase from appropriately transfected yeast colonies.

3. Transformation and Detection

DNA from the library described in paragraph 2 above was chilled on ice to which was added electrocompetent DH10B bacteria (Life Technologies, 20 ml). The bacteria and vector mixture was then electroporated as recommended by the manufacturer. Subsequently, SOC media (Life Technologies, 1 ml) was added and the mixture was incubated at 37° C. for 30 minutes. The transformants were then plated onto 20 standard 150 mm LB plates containing ampicillin and incubated for 16 hours (37° C.). Positive colonies were scraped off the plates and the DNA was isolated from the bacterial pellet using standard protocols, e.g. CsCl-gradient. The purified DNA was then carried on to the yeast protocols below.

The yeast methods were divided into three categories: (1) Transformation of yeast with the plasmid/cDNA combined vector; (2) Detection and isolation of yeast clones secreting amylase; and (3) PCR amplification of the insert directly from the yeast colony and purification of the DNA for sequencing and further analysis.

The yeast strain used was HD56-5A (ATCC-90785). This strain has the following genotype: MAT alpha, ura3-52, leu2-3, leu2-112, his3-11, his3-15, MAL$^+$, SUC$^+$, GAL$^+$. Preferably, yeast mutants can be employed that have deficient post-translational pathways. Such mutants may have translocation deficient alleles in sec71, sec72, sec62, with truncated sec71 being most preferred. Alternatively, antagonists (including antisense nucleotides and/or ligands) which interfere with the normal operation of these genes, other proteins implicated in this post translation pathway (e.g., SEC61p, SEC72p, SEC62p, SEC63p, TDJ1p or SSA1-p4p) or the complex formation of these proteins may also be preferably employed in combination with the amylase-expressing yeast.

Transformation was performed based on the protocol outlined by Gietz et al., *Nucl. Acid. Res.*, 20:1425 (1992). Transformed cells were then inoculated from agar into YEPD complex media broth (100 ml) and grown overnight at 30° C. The YEPD broth was prepared as described in Kaiser et al., *Methods in Yeast Genetics*, Cold Spring Harbor Press, Cold Spring Harbor, N.Y., p. 207 (1994). The overnight culture was then diluted to about $2 \times 10^6$ cells/ml (approx. OD$_{600}$=0.1) into fresh YEPD broth (500 ml) and regrown to $1 \times 10^7$ cells/ml (approx. OD$_{600}$=0.4–0.5).

The cells were then harvested and prepared for transformation by transfer into GS3 rotor bottles in a Sorval GS3 rotor at 5,000 rpm for 5 minutes, the supernatant discarded, and then resuspended into sterile water, and centrifuged again in 50 ml falcon tubes at 3,500 rpm in a Beckman GS-6KR centrifuge. The supernatant was discarded and the cells were subsequently washed with LiAc/TE (10 ml, 10 mM Tris-HCl, 1 mM EDTA pH 7.5, 100 mM Li$_2$OOCCH$_3$), and resuspended into LiAc/TE (2.5 ml).

Transformation took place by mixing the prepared cells (100 µl) with freshly denatured single stranded salmon testes DNA (Lofstrand Labs, Gaithersburg, Md.) and transforming DNA (1 µg, vol. <10 µl) in microfuge tubes. The mixture was mixed briefly by vortexing, then 40% PEG/TE (600 µl, 40% polyethylene glycol4000, 10 mM Tris-HCl, 1 mM EDTA, 100 mM Li$_2$OOCCH$_3$, pH 7.5) was added. This mixture was gently mixed and incubated at 30° C. while agitating for 30 minutes. The cells were then heat shocked at 42° C. for 15 minutes, and the reaction vessel centrifuged in a microfuge at 12,000 rpm for 5–10 seconds, decanted and resuspended into TE (500 µl, 10 mM Tris-HCl, 1 mM EDTA pH 7.5) followed by recentrifugation. The cells were then diluted into TE (1 ml) and aliquots (200 µl) were spread onto the selective media previously prepared in 150 mm growth plates (VWR).

Alternatively, instead of multiple small reactions, the transformation was performed using a single, large scale reaction, wherein reagent amounts were scaled up accordingly.

The selective media used was a synthetic complete dextrose agar lacking uracil (SCD-Ura) prepared as described in Kaiser et al., *Methods in Yeast Genetics*, Cold Spring Harbor Press, Cold Spring Harbor, N.Y., p. 208–210 (1994). Transformants were grown at 30° C. for 2–3 days.

The detection of colonies secreting amylase was performed by including red starch in the selective growth media. Starch was coupled to the red dye (Reactive Red-120, Sigma) as per the procedure described by Biely et al., *Anal. Biochem.*, 172:176–179 (1988). The coupled starch was incorporated into the SCD-Ura agar plates at a final concentration of 0.15% (w/v), and was buffered with potassium phosphate to a pH of 7.0 (50–100 mM final concentration).

The positive colonies were picked and streaked across fresh selective media (onto 150 mm plates) in order to obtain well isolated and identifiable single colonies. Well isolated single colonies positive for amylase secretion were detected by direct incorporation of red starch into buffered SCD-Ura agar. Positive colonies were determined by their ability to break down starch resulting in a clear halo around the positive colony visualized directly.

4. Isolation of DNA by PCR Amplification

When a positive colony was isolated, a portion of it was picked by a toothpick and diluted into sterile water (30 µl) in a 96 well plate. At this time, the positive colonies were either frozen and stored for subsequent analysis or immediately amplified. An aliquot of cells (5 µl) was used as a template for the PCR reaction in a 25 µl volume containing: 0.5 µl Klentaq (Clontech, Palo Alto, Calif.); 4.0 µl 10 mM dNTP's (Perkin Elmer-Cetus); 2.5 µl Kentaq buffer (Clontech); 0.25 µl forward oligo 1;0.25 µl reverse oligo 2; 12.5 µl distilled water.

The sequence of the forward oligonucleotide 1 was:

```
                                           (SEQ ID NO:324)
5'-TGTAAAACGACGGCCAGT

TAAATAGACCTGCAATTATTAATCT-3'
```

The sequence of reverse oligonucleotide 2 was:

```
                                           (SEQ ID NO:325)
5'-CAGGAAACAGCTATGACC

ACCTGCACACCTGCAAATCCATT-3'
```

PCR was then performed as follows:

| a. | | Denature | 92° C., | 5 minutes |
|---|---|---|---|---|
| b. | 3 cycles of: | Denature | 92° C., | 30 seconds |
| | | Anneal | 59° C., | 30 seconds |
| | | Extend | 72° C., | 60 seconds |
| c. | 3 cycles of: | Denature | 92° C., | 30 seconds |
| | | Anneal | 57° C., | 30 seconds |
| | | Extend | 72° C., | 60 seconds |
| d. | 25 cycles of: | Denature | 92° C., | 30 seconds |
| | | Anneal | 55° C., | 30 seconds |
| | | Extend | 72° C., | 60 seconds |
| e. | | Hold | 4° C. | |

The underlined regions of the oligonucleotides annealed to the ADH promoter region and the amylase region, respectively, and amplified a 307 bp region from vector pSST-AMY.0 when no insert was present. Typically, the first 18 nucleotides of the 5' end of these oligonucleotides contained annealing sites for the sequencing primers. Thus, the total product of the PCR reaction from an empty vector was 343 bp. However, signal sequence-fused cDNA resulted in considerably longer nucleotide sequences.

Following the PCR, an aliquot of the reaction (5 µl) was examined by agarose gel electrophoresis in a 1% agarose gel using a Tris-Borate-EDTA (TBE) buffering system as described by Sambrook et al., supra. Clones resulting in a single strong PCR product larger than 400 bp were further analyzed by DNA sequencing after purification with a 96 Qiaquick PCR clean-up column (Qiagen Inc., Chatsworth, Calif.).

Example 3

Isolation of cDNA Clones Encoding Human PRO213

A consensus sequence was obtained relative to a variety of EST sequences as described in Example 1 above, wherein the consensus sequence obtained is herein designated DNA28735. Based on the DNA28735 consensus sequence, oligonucleotides were synthesized: 1) to identify by PCR a cDNA library that contained the sequence of interest, and 2) for use as probes to isolate a clone of the full-length coding sequence for PRO213.

A pair of PCR primers (forward and reverse) were synthesized:

```
forward PCR primer
5'-TGGAGCAGCAATATGCCAGCC-3'      (SEQ ID NO:3)

reverse PCR primer
5'-TTTTCCACTCCTGTCGGGTTGG-3'     (SEQ ID NO:4)
```

Additionally, a synthetic oligonucleotide hybridization probe was constructed from the consensus DNA28735 sequence which had the following nucleotide sequence

```
hybridization probe                (SEQ ID NO:5)
5'-GGTGACACTTGCCAGTCAGATGTGGATGAATGCAGTGC

TAGGAGGG-3'
```

In order to screen several libraries for a source of a full-length clone, DNA from the libraries was screened by PCR amplification with the PCR primer pair identified above. A positive library was then used to isolate clones encoding the PRO213 gene using the probe oligonucleotide and one of the PCR primers. RNA for construction of the cDNA libraries was isolated from human fetal lung tissue.

DNA sequencing of the clones isolated as described above gave the full-length DNA sequence for PRO213 [herein designated as UNQ187 (DNA30943-1163)] (SEQ ID NO:1) and the derived protein sequence for PRO213.

The entire nucleotide sequence of UNQ187 (DNA30943-1163) is shown in FIG. 1 (SEQ ID NO:1). Clone UNQ187 (DNA30943-1163) contains a single open reading frame with an apparent translational initiation site at nucleotide positions 336–338 and ending at the stop codon at nucleotide positions 1221–1223 (FIG. 1). The predicted polypeptide precursor is 295 amino acids long (FIG. 2). Clone UNQ187 (DNA30943-1163) has been deposited with ATCC.

Analysis of the amino acid sequence of the full-length PRO213 polypeptide suggests that a portion of it possesses significant homology to the human growth arrest-specific gene 6 protein. More specifically, an analysis of the Dayhoff database (version 35.45 SwissProt 35) evidenced significant homology between the PRO213 amino acid sequence and the following Dayhoff sequences, HSMHC3W5A_6 and B48089.

Example 4

Isolation of cDNA Clones Encoding Human PRO274

A consensus sequence was obtained relative to a variety of EST sequences as described in Example 1 above, wherein the consensus sequence obtained is herein designated DNA36469. Based on the DNA36469 consensus sequence, oligonucleotides were synthesized: 1) to identify by PCR a cDNA library that contained the sequence of interest, and 2) for use as probes to isolate a clone of the full-length coding sequence for PRO274. ESTs proprietary to Genentech were employed in the consensus assembly. The ESTs are shown in FIGS. 5–7 and are herein designated DNA17873, DNA36157 and DNA28929, respectively.

Pairs of PCR primers (forward and reverse) were synthesized:

```
forward PCR primer 1 (36469.f1)
5'-CTGATCCGGTTCTTGGTGCCCCTG-3'      (SEQ ID NO:11)

forward PCR primer 2 (36469.f2)
5'-GCTCTGTCACTCACGCTC-3'            (SEQ ID NO:12)

forward PCR primer 3 (36469.f3)
5'-TCATCTCTTCCCTCTCCC-3'            (SEQ ID NO:13)

forward PCR primer 4 (36469.f4)
5'-CCTTCCGCCACGGAGTTC-3'            (SEQ ID NO:14)

reverse PCR primer 1 (36469.r1)
5'-GGCAAAGTCCACTCCGATGATGTC-3'      (SEQ ID NO:15)

reverse PCR primer 2 (36469.r2)
5'-GCCTGCTGTGGTCACAGGTCTCCG-3'      (SEQ ID NO:16)
```

Additionally, a synthetic oligonucleotide hybridization probe was constructed from the consensus DNA36469 sequence which had the following nucleotide sequence

```
hybridization probe (36469.p1)          (SEQ ID NO:17)
5'-TCGGGAGCAGGCCTTGAACCGGGGCATTGCTGCTGTCAAGGAGG-3'
```

In order to screen several libraries for a source of a full-length clone, DNA from the libraries was screened by PCR amplification with the PCR primer pair identified above. A positive library was then used to isolate clones encoding the PRO274 gene using the probe oligonucleotide and one of the PCR primers. RNA for construction of the cDNA libraries was isolated from human fetal liver tissue (LIB229).

DNA sequencing of the clones isolated as described above gave the full-length DNA sequence for PRO274 [herein designated as UNQ241 (DNA39987-1184)] (SEQ ID NO:1) and the derived protein sequence for PRO274.

The entire nucleotide sequence of UNQ241 (DNA39987-1184) is shown in FIG. 3 (SEQ ID NO:6). Clone UNQ241 (DNA39987-1184) contains a single open reading frame with an apparent translational initiation site at nucleotide positions 83–85 and ending at the stop codon at nucleotide positions 1559–1561 (FIG. 3). The predicted polypeptide precursor is 492 amino acids long (FIG. 4), has an estimated molecular weight of about 54,241 daltons and an estimated pI of about 8.21. Clone UNQ241 (DNA39987-1184) has been deposited with ATCC and is assigned ATCC deposit no. 209786.

Analysis of the amino acid sequence of the full-length PRO274 polypeptide suggests that it possesses significant homology to the Fn54 protein. More specifically, an analysis of the Dayhoff database (version 35.45 SwissProt 35) evidenced significant homology between the PRO274 amino acid sequence and the following Dayhoff sequences, MMFN54S2_1, MMFN54S1_1, CELF48C1_8, CEF38B7_6, PRP3_RAT, INL3_PIG, MTCY07A7_13, YNAX_KLEAE, A47234 and HME2_MOUSE.

Example 5

Isolation of cDNA Clones Encoding Human PRO300

A consensus sequence was obtained relative to a variety of EST sequences as described in Example 1 above, wherein the consensus sequence obtained is herein designated DNA35930. Based on the DNA35930 consensus sequence, oligonucleotides were synthesized: 1) to identify by PCR a cDNA library that contained the sequence of interest, and 2) for use as probes to isolate a clone of the full-length coding sequence for PRO300.

Forward and reverse PCR primers were synthesized:

```
forward PCR primer 1 (35930.f1)
5'-GCCGCCTCATCTTCACGTTCTTCC-3'      (SEQ ID NO:20)

forward PCR primer 2 (35930.f2)
5'-TCATCCAGCTGGTGCTGCTC-3'          (SEQ ID NO:21)

forward PCR primer 3 (35930.f3)
5'-CTTCTTCCACTTCTGCCTGG-3'          (SEQ ID NO:22)

forward PCR primer 4 (35930.f4)
5'-CCTGGGCAAAAATGCAAC-3'            (SEQ ID NO:23)

reverse PCR primer 1 (35930.r1)
5'-CAGGAATGTAGAAGGCACCCACGG-3'      (SEQ ID NO:24)

reverse PCR primer 2 (35930.r2)
5'-TGGCACAGATCTTCACCCACACGG-3'      (SEQ ID NO:25)
```

Additionally, a synthetic oligonucleotide hybridization probe was constructed from the consensus DNA35930 sequence which had the following nucleotide sequence

```
hybridization probe (35930.p1)          (SEQ ID NO:26)
5'-TGTCCATCATTATGCTGAGCCCGGGCGTGGAGAGTCA

GCTCTACAAGCTG-3'
```

In order to screen several libraries for a source of a full-length clone, DNA from the libraries was screened by PCR amplification with the PCR primer pair identified above. A positive library was then used to isolate clones encoding the PRO300 gene using the probe oligonucleotide and one of the PCR primers. RNA for construction of the cDNA libraries was isolated from human fetal kidney tissue.

DNA sequencing of the clones isolated as described above gave the full-length DNA sequence for PRO300 [herein designated as UNQ263 (DNA40625-1189)] (SEQ ID NO:18) and the derived protein sequence for PRO300.

The entire nucleotide sequence of UNQ263 (DNA40625-1189) is shown in FIG. 8 (SEQ ID NO:18). Clone UNQ263 (DNA40625-1189) contains a single open reading frame with an apparent translational initiation site at nucleotide positions 45–47 and ending at the stop codon at nucleotide positions 1416–1418 (FIG. 8). The predicted polypeptide precursor is 457 amino acids long (FIG. 9). Clone UNQ263 (DNA40625-1189) has been deposited with ATCC and is assigned ATCC deposit no. 209788.

Analysis of the amino acid sequence of the full-length PRO300 polypeptide suggests that portions of it possess significant homology to the Diff 33 protein. More specifically, an analysis of the Dayhoff database (version 35.45 SwissProt 35) evidenced significant homology between the PRO300 amino acid sequence and the following Dayhoff sequence, HSU49188_1.

Example 6

Isolation of cDNA Clones Encoding Human PRO284

Two cDNA sequences were isolated in the amylase screen described in Example 2 and those cDNA sequences are herein designated DNA12982 (see FIG. 12; human placenta-derived) and DNA15886 (see FIG. 13; human salivary gland-derived). The DNA12982 and DNA15886 sequences were then clustered and aligned, giving rise to a consensus nucleotide sequence herein designated DNA18832.

Based on the DNA18832 consensus sequence, oligonucleotide probes were generated and used to screen a human placenta library (LIB89) prepared as described in paragraph 1 of Example 2 above. The cloning vector was pRK5B (pRK5B is a precursor of pRK5D that does not contain the SfiI site; see, Holmes et al., Science, 253: 1278–1280 (1991)), and the cDNA size cut was less than 2800 bp.

PCR primers (forward and reverse) were synthesized:

```
forward PCR primer 1 (18832.est.f)
5'-TCGTACAGTTACGCTCTCCC-3'         (SEQ ID NO:31)

forward PCR primer 2 (18832.f)
5'-CTTGAGGAGCGTCAGAAGCG-3'         (SEQ ID NO:32)

reverse PCR primer (18832.r)
5'-ATAACGAATGAAGCCTCGTG-3'         (SEQ ID NO:33)
```

Additionally, a synthetic oligonucleotide hybridization probe was constructed from the DNA18832 sequence which had the following nucleotide sequence

```
hybridization probe (18832.p)         (SEQ ID NO:34)
5'-GCTAATATCTGTAAGACGGCAGCTACAGCAGGCATCATTG-3'
```

In order to screen several libraries for a source of a full-length clone, DNA from the libraries was screened by PCR amplification with the PCR primer pairs identified above. A positive library was then used to isolate clones encoding the PRO284 gene using the probe oligonucleotide and one of the PCR primers.

A full length clone was identified that contained a single open reading frame with an apparent translational initiation site at nucleotide positions 167–169 and ending at the stop codon found at nucleotide positions 1022–1024 (FIG. 10; SEQ ID NO:27). The predicted polypeptide precursor is 285 amino acids long, has a calculated molecular weight of approximately 32,190 daltons and an estimated pI of approximately 9.03. Analysis of the full-length PRO284 sequence shown in FIG. 11 (SEQ ID NO:28) evidences the presence of the following: a signal peptide from about amino acid 1 to about amino acid 24, transmembrane domains from about amino acid 76 to about amino acid 96 and from about amino acid 171 to about amino acid 195 and a potential N-glycosylation site from about amino acid 153 to about amino acid 156. Clone UNQ247 (DNA23318-1211) has been deposited with ATCC on Apr. 21, 1998 and is assigned ATCC deposit no. 209787.

Analysis of the amino acid sequence of the full-length PRO284 polypeptide suggests that it possesses no significant sequence similarity to any known protein. However, an analysis of the Dayhoff database (version 35.45 SwissProt 35) evidenced some degree of homology between the PRO284 amino acid sequence and the following Dayhoff sequences, JQ0124, CELE04A4_5, AB006451_1, AF030162_1, IM23_YEAST, S71194, NIA_CUCMA, IM17_YEAST, I50479 and HUMZFHP_1.

Example 7

Isolation of cDNA Clones Encoding Human PRO296

A cDNA sequence isolated in the amylase screen as described in Example 2 above was found, by BLAST and FastA sequence alignment, to have sequence homology to a nucleotide sequence encoding sarcoma-associated protein SAS. This cDNA sequence is herein designated DNA23020 (see FIG. 16). The DNA23020 sequence was then compared to a variety of expressed sequence tag (EST) databases which included public EST databases (e.g., GenBank) and a proprietary EST DNA database (LIIFESEQ™, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash. The consensus sequence obtained therefrom is herein designated DNA35858. Two proprietary Genentech ESTs were employed in the assembly wherein those EST sequences are herein identified as DNA21971 (FIG. 17; SEQ ID NO:38) and DNA29037 (FIG. 18; SEQ ID NO:39).

Based on the DNA35858 consensus sequence, oligonucleotide probes were generated and used to screen a human kidney library (LIB228) library prepared as described in paragraph 1 of Example 2 above. The cloning vector was pRK5B (pRK5B is a precursor of pRK5D that does not contain the SfiI site; see, Holmes et al., Science, 253:1278–1280 (1991)), and the cDNA size cut was less than 2800 bp.

PCR primers (forward and reverse) were synthesized:

```
forward PCR primer 1 (35858.f1)
5'-ACCCACGTCTGCGTTGCTGCC-3'         (SEQ ID NO:40)
```

-continued

```
forward PCR primer 2 (35858.f2)
5'-GAGAATATGCTGGAGAGG-3'           (SEQ ID NO:41)

reverse PCR primer (35858.r1)
5'-AGGAATGCACTAGGATTCGCGCGG-3'     (SEQ ID NO:42)
```

Additionally, a synthetic oligonucleotide hybridization probe was constructed from the consensus DNA35858 sequence which had the following nucleotide sequence

```
hybridization probe (35858.p1)         (SEQ ID NO:43)
5'-GGCCCCAAAGGCAAGGACAAAGCAGCTGTCAGGGAACCTCCGCCG-3'
```

In order to screen several libraries for a source of a full-length clone, DNA from the libraries was screened by PCR amplification with the PCR primer pair identified above. A positive library was then used to isolate clones encoding the PRO296 gene using the probe oligonucleotide and one of the PCR primers.

A full length clone was identified that contained a single open reading frame with an apparent translational initiation site at nucleotide positions 174–176 and ending at the stop codon found at nucleotide positions 786–788 (FIG. 14; SEQ ID NO:35). The predicted polypeptide precursor is 204 amino acids long, has a calculated molecular weight of approximately 22,147 daltons and an estimated pI of approximately 8.37. Analysis of the full-length PRO296 sequence shown in FIG. 15 (SEQ ID NO:36) evidences the presence of the following: a signal peptide from about amino acid 1 to about amino acid 34 and transmembrane domains from about amino acid 47 to about amino acid 63, from about amino acid 72 to about amino acid 95 and from about amino acid 162 to about amino acid 182. Clone UNQ260 (DNA39979-1213) has been deposited with ATCC on Apr. 21, 1998 and is assigned ATCC deposit no. 209789.

Analysis of the amino acid sequence of the full-length PRO296 polypeptide suggests that it possesses significant sequence similarity to the sarcoma-amplified SAS protein, thereby indicating that PRO296 may be a novel SAS homolog. More specifically, an analysis of the Dayhoff database (version 35.45 SwissProt 35) evidenced significant homology between the PRO296 amino acid sequence and the following Dayhoff sequences, I58391, GEN11061, SSC2B04_1, HSU81031_2, CD63_RAT, CD63_MOUSE, CD63_HUMAN, AF022813_1, CD63_RABIT and CO02_HUMAN.

Example 8

Isolation of cDNA Clones Encoding Human PRO329

A consensus sequence was obtained relative to a variety of EST sequences as described in Example 1 above, wherein the consensus sequence obtained is herein designated DNA35612. Based on the DNA35612 consensus sequence, oligonucleotides were synthesized: 1) to identify by PCR a cDNA library that contained the sequence of interest, and 2) for use as probes to isolate a clone of the full-length coding sequence for PRO329.

PCR primers (forward and reverse) were synthesized:

```
forward PCR primer 1 (35612.f1)
5'-TGGGCTGTGTCCTCATGG-3'           (SEQ ID NO:46)
```

-continued

```
forward PCR primer 2 (35612.f2)
5'-TTTCCAGCGCCAATTCTC-3'           (SEQ ID NO:47)

reverse PCR primer 1 (35612.r1)
5'-AGTTCTTGGACTGTGATAGCCAC-3'      (SEQ ID NO:48)

reverse PCR primer 2 (35612.r2)
5'-AAACTTGGTTGTCCTCAGTGGCTG-3'     (SEQ ID NO:49)
```

Additionally, a synthetic oligonucleotide hybridization probe was constructed from the consensus DNA35612 sequence which had the following nucleotide sequence

```
hybridization probe (35612.p1)         (SEQ ID NO:50)
5'-GTGAGGGACCTGTCTGCACTGAGGAGAGCAGCTGCCACACGGAGG-3'
```

In order to screen several libraries for a source of a full-length clone, DNA from the libraries was screened by PCR amplification with the PCR primer pairs identified above. A positive library was then used to isolate clones encoding the PRO329 gene using the probe oligonucleotide and one of the PCR primers. RNA for construction of the cDNA libraries was isolated from human fetal liver tissue (LIB6).

DNA sequencing of the clones isolated as described above gave the full-length DNA sequence for PRO329 [herein designated as UNQ291 (DNA40594-1233)] (SEQ ID NO:44) and the derived protein sequence for PRO329.

The entire nucleotide sequence of UNQ291 (DNA40594-1233) is shown in FIG. 19 (SEQ ID NO:44). Clone UNQ291 (DNA40594-1233) contains a single open reading frame with an apparent translational initiation site at nucleotide positions 9–11 and ending at the stop codon at nucleotide positions 1086–1088 (FIG. 19). The predicted polypeptide precursor is 359 amino acids long (FIG. 20). The full-length PRO329 protein shown in FIG. 20 has an estimated molecular weight of about 38,899 daltons and a pI of about 5.21. Clone UNQ291 (DNA40594-1233) has been deposited with ATCC on Feb. 5, 1998 and is assigned ATCC deposit no. 209617.

Analysis of the amino acid sequence of the full-length PRO329 polypeptide suggests that it possesses significant sequence similarity to a high affinity immunoglobulin $F_c$, receptor protein. More specifically, an analysis of the Dayhoff database (version 35.45 SwissProt 35) evidenced significant homology between the PRO329 amino acid sequence and the following Dayhoff sequences, FCG1_HUMAN, FCG0_HUMAN, P_R91439, P_R22549, P_R91438, P_W00859, P_R20811, P_R22550, HUMCD6406_1 and FCG1_MOUSE.

Example 9

Isolation of cDNA Clones Encoding Human PRO362

A consensus sequence was obtained relative to a variety of EST sequences as described in Example 1 above, wherein the consensus sequence obtained is herein designated DNA42257. Based on the DNA42257 consensus sequence, oligonucleotides were synthesized: 1) to identify by PCR a cDNA library that contained the sequence of interest, and 2) for use as probes to isolate a clone of the full-length coding sequence for PRO362.

PCR primers (forward and reverse) were synthesized:

```
forward PCR primer 1 (42257.f1)
5'-TATCCCTCCAATTGAGCACCCTGG-3'      (SEQ ID NO:53)

forward PCR primer 2 (42257.f2)
5'-GTCGGAAGACATCCCAACAAG-3'         (SEQ ID NO:54)

reverse PCR primer 1 (42257.r1)
5'-CTTCACAATGTCGCTGTGCTGCTC-3'      (SEQ ID NO:55)

reverse PCR primer 2 (42257.r2)
5'-AGCCAAATCCAGCAGCTGGCTTAC-3'      (SEQ ID NO:56)
```

Additionally, a synthetic oligonucleotide hybridization probe was constructed from the consensus DNA42257 sequence which had the following nucleotide sequence

```
hybridization probe (42257.p1)      (SEQ ID NO:57)
5'-TGGATGACCGGAGCCACTACACGTGTGAAGTCACCTG

GCAGACTCCTGAT-3'
```

In order to screen several libraries for a source of a full-length clone, DNA from the libraries was screened by PCR amplification with the PCR primer pairs identified above. A positive library was then used to isolate clones encoding the PRO362 gene using the probe oligonucleotide and one of the PCR primers. RNA for construction of the cDNA libraries was isolated from human fetal brain tissue (LIB153).

DNA sequencing of the clones isolated as described above gave the full-length DNA sequence for PRO362 [herein designated as UNQ317 (DNA45416-1251)] (SEQ ID NO:51) and the derived protein sequence for PRO362.

The entire nucleotide sequence of UNQ317 (DNA45416-1251) is shown in FIG. 21 (SEQ ID NO:51). Clone UNQ317 (DNA45416-1251) contains a single open reading frame with an apparent translational initiation site at nucleotide positions 119–121 and ending at the stop codon at nucleotide positions 1082–1084 (FIG. 21). The predicted polypeptide precursor is 321 amino acids long (FIG. 22). The full-length PRO362 protein shown in FIG. 2 has an estimated molecular weight of about 35,544 daltons and a pI of about 8.51. Analysis of the full-length PRO362 polypeptide as shown in FIG. 22 evidences the presence of a glycosaminoglycan attachment site at about amino acid 149 to about amino acid 152 and a transmembrane domain from about amino acid 276 to about amino acid 306. Clone UNQ317 (DNA45416-1251) has been deposited with ATCC on Feb. 5, 1998 and is assigned ATCC deposit no. 209620.

Analysis of the amino acid sequence of the full-length PRO362 polypeptide suggests that it possesses significant sequence similarity to the A33 antigen protein and the HCAR protein. More specifically, an analysis of the Dayhoff database (version 35.45 SwissProt 35) evidenced significant homology between the PRO362 amino acid sequence and the following Dayhoff sequences, AB002341_1, HSU55258_1, HSC7NRCAM_1, RNU81037_1, A33_HUMAN, P_W14158, NMNCAMRI_1, HSTITINN2_1, S71824_1 and HSU63041_1.

Example 10

Isolation of cDNA Clones Encoding Human PRO363

A consensus sequence was obtained relative to a variety of EST sequences as described in Example 1 above, wherein the consensus sequence obtained is herein designated DNA42828. Based on the DNA42828 consensus sequence, oligonucleotides were synthesized: 1) to identify by PCR a cDNA library that contained the sequence of interest, and 2) for use as probes to isolate a clone of the full-length coding sequence for PRO363.

A pair of PCR primers (forward and reverse) were synthesized:

```
forward PCR primer (42828.f1)
5'-CCAGTGCACAGCAGGCAACGAAGC-3'      (SEQ ID NO:60)

reverse PCR primer (42828.r1)
5'-ACTAGGCTGTATGCCTGGGTGGGC-3'      (SEQ ID NO:61)
```

Additionally, a synthetic oligonucleotide hybridization probe was constructed from the consensus DNA42828 sequence which had the following nucleotide sequence

```
hybridization probe (42828.p1)      (SEQ ID NO:62)
5'-GTATGTACAAAGCATCGGCATGGTTGCAGGAGCAGTGACAGGC-3'
```

In order to screen several libraries for a source of a full-length clone, DNA from the libraries was screened by PCR amplification with the PCR primer pair identified above. A positive library was then used to isolate clones encoding the PRO363 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO363 [herein designated as UNQ318 (DNA45419-1252)] (SEQ ID NO:58) and the derived protein sequence for PRO363.

The entire nucleotide sequence of UNQ318 (DNA45419-1252) is shown in FIG. 23 (SEQ ID NO:58). Clone UNQ318 (DNA45419-1252) contains a single open reading frame with an apparent translational initiation site at nucleotide positions 190–192 and ending at the stop codon at nucleotide positions 1309–1311 (FIG. 23). The predicted polypeptide precursor is 373 amino acids long (FIG. 24). The full-length PRO363 protein shown in FIG. 24 has an estimated molecular weight of about 41,281 daltons and a pI of about 8.33. A transmembrane domain exists at amino acids 221 to 254 of the amino acid sequence shown in FIG. 24 (SEQ ID NO:59). The PRO363 polypeptide also possesses at least two myelin P0 protein domains from about amino acids 15 to 56 and from about amino acids 87 to 116. Clone UNQ318 (DNA45419-1252) has been deposited with ATCC on Feb. 5, 1998 and is assigned ATCC deposit no. 209616.

Analysis of the amino acid sequence of the full-length PRO363 polypeptide suggests that it possesses significant sequence similarity to the cell surface protein HCAR, thereby indicating that PRO363 may be a novel HCAR homolog. More specifically, an analysis of the Dayhoff database (version 35.45 SwissProt 35) evidenced significant homology between the PRO363 amino acid sequence and the following Dayhoff sequences, HS46KDA_1, HSU90716_1, MMCARH_1, MMCARHOM_1, MMU90715_1, A33_HUMAN, P_W14146, P_W14158, A42632 and B42632.

Example 11

Isolation of cDNA Clones Encoding Human PRO868

A consensus sequence was obtained relative to a variety of EST sequences as described in Example 1 above, wherein the consensus sequence obtained is herein designated DNA38133. Based on the DNA38133 consensus sequence, oligonucleotides were synthesized: 1) to identify by PCR a cDNA library that contained the sequence of interest, and 2) for use as probes to isolate a clone of the full-length coding sequence for PRO868.

A pair of PCR primers (forward and reverse) were synthesized:

```
forward PCR primer (38133.f1)
5'-GTAGCAGTGCACATGGGGTGTTGG-3'      (SEQ ID NO:65)

reverse PCR primer (38133.r1)
5'-ACCGCACATCCTCAGTCTCTGTCC-3'      (SEQ ID NO:66)
```

Additionally, a synthetic oligonucleotide hybridization probe was constructed from the consensus DNA38133 sequence which had the following nucleotide sequence

```
hybridization probe (38133.p1)      (SEQ ID NO:67)
5'-ACGATGATCGCGGGCTCCCTTCTCCTGCTTGGATTCC
TTAGCACCACCAC-3'
```

In order to screen several libraries for a source of a full-length clone, DNA from the libraries was screened by PCR amplification with the PCR primer pair identified above. A positive library was then used to isolate clones encoding the PRO868 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO868 [herein designated as UNQ437 (DNA52594-1270)] (SEQ ID NO:63) and the derived protein sequence for PRO868.

The entire nucleotide sequence of UNQ437 (DNA52594-1270) is shown in FIG. 25 (SEQ ID NO:63). Clone UNQ437 (DNA52594-1270) contains a single open reading frame with an apparent translational initiation site at nucleotide positions 325–327 and ending at the stop codon at nucleotide positions 2290–2292 (FIG. 25). The predicted polypeptide precursor is 655 amino acids long (FIG. 26). The full-length PRO868 protein shown in FIG. 26 has an estimated molecular weight of about 71,845 daltons and a pI of about 8.22. Analysis of the full-length PRO868 polypeptide sequence demonstrates the presence of conserved cysteine-containing domains from about amino acid 66 to about amino acid 78 and from about amino acid 123 to about amino acid 134 of the sequence shown in FIG. 26 (SEQ ID NO:3), a TNFR death domain from about amino acid 85 to about amino acid 110, a FASA_mouse death domain block from about amino acid 159 to about amino acid 175 and a transmembrane domain from about amino acid 347 to about amino acid 375. Clone UNQ437 (DNA52594-1270) has been deposited with ATCC on Mar. 17, 1998 and is assigned ATCC deposit no. 209679

Analysis of the amino acid sequence of the full-length PRO868 polypeptide suggests that it possesses significant sequence similarity to the tumor necrosis factor receptor protein, thereby indicating that PRO868 may be a novel member of the tumor necrosis factor receptor family. More specifically, an analysis of the Dayhoff database (version 35.45 SwissProt 35) evidenced significant homology between the PRO868 amino acid sequence and the following Dayhoff sequences, RNU94330_1, P_R99933, P_R99945, P_R99950, HSU94332_1, CD40_HUMAN, S63368_1, TNR2_HUMAN, MVU87844_1 AND CVU87837_1.

Example 12

Isolation of cDNA Clones Encoding Human PRO382

A consensus sequence was obtained relative to a variety of EST sequences as described in Example 1 above, wherein the consensus sequence obtained is herein designated DNA30892. Based on the DNA30892 consensus sequence, oligonucleotides were synthesized: 1) to identify by PCR a cDNA library that contained the sequence of interest, and 2) for use as probes to isolate a clone of the full-length coding sequence for PRO382.

A pair of PCR primers (forward and reverse) were synthesized:

```
forward PCR primer
5'-TGACATCGCCCTTATGAAGCTGGC-3'      (SEQ ID NO:70)

reverse PCR primer
5'-TACACGTCCCTGTGGTTGCAGATC-3'      (SEQ ID NO:71)
```

Additionally, a synthetic oligonucleotide hybridization probe was constructed from the consensus DNA30892 sequence which had the following nucleotide sequence

```
hybridization probe                 (SEQ ID NO:72)
5'-CGTTCAATGCAGAAATGATCCAGCCTGTGTGCCTGCC
CAACTCTGAAGAG-3'
```

In order to screen several libraries for a source of a full-length clone, DNA from the libraries was screened by PCR amplification with the PCR primer pair identified above. A positive library was then used to isolate clones encoding the PRO382 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO382 [herein designated as UNQ323 (DNA45234-1277)] (SEQ ID NO:68) and the derived protein sequence for PRO382.

The entire nucleotide sequence of UNQ323 (DNA45234-1277) is shown in FIG. 27 (SEQ ID NO:68). Clone UNQ323 (DNA45234-1277) contains a single open reading frame with an apparent translational initiation site at nucleotide positions 126–128 and ending at the stop codon at nucleotide positions 1485–1487 (FIG. 27). The predicted polypeptide precursor is 453 amino acids long (FIG. 28). The full-length PRO382 protein shown in FIG. 28 has an estimated molecular weight of about 49,334 daltons and a pI of about 6.32. Analysis of the native PRO382 amino acid sequence shown in FIG. 28 (SEQ ID NO:69) indicates the presence of a putative transmembrane domain from about amino acid 240 to about amino acid 284, a putative signal peptide at about amino acid 1 to about amino acid 20, a putative apple domain at about amino acid 386 to about amino acid 419, a putative Kringle domain at about amino acid 394 to about amino acid 406 and a histidine-containing protease active site at about amino acid 253 to about amino acid 258. Clone UNQ323 (DNA45234-1277) has been deposited with ATCC on Mar. 5, 1998 and is assigned ATCC deposit no. 209654.

Analysis of the amino acid sequence of the full-length PRO382 polypeptide suggests that it possess significant homology to serine protease proteins, thereby indicating that PRO382 may be a novel serine protease. Specifically, an analysis of the Dayhoff database (version 35.45 SwissProt 35) evidenced significant homology between the PRO382 amino acid sequence and the following Dayhoff sequences, HSU75329_1, ENTK_MOUSE, HEPS_HUMAN, AF030065_1, HEPS_RAT, PLMN_PIG, P_R89430, P_R89435, PLMN_HORSE, PLMN_BOVIN and P_R83959.

Example 13

Isolation of cDNA Clones Encoding Human PRO545

A consensus sequence was obtained relative to a variety of EST sequences as described in Example 1 above, wherein the consensus sequence obtained is herein designated DNA44706. An EST proprietary to Genentech was employed in the consensus assembly and is herein designated DNA13217 (FIG. 31; SEQ ID NO:75). Based on the DNA44706 consensus sequence, oligonucleotides were synthesized: 1) to identify by PCR a cDNA library that contained the sequence of interest, and 2) for use as probes to isolate a clone of the full-length coding sequence for PRO545.

Forward and reverse PCR primers were synthesized:

```
forward PCR primer 1
5'-GTCTCAGCACGTGTTCTGGTCTCAGGG-3'    (SEQ ID NO:76)

forward PCR primer 2
5'-CATGAGCATGTGCACGGC-3'              (SEQ ID NO:77)

forward PCR primer 3
5'-TACCTGCACGATGGGCAC-3'              (SEQ ID NO:78)

forward PCR primer 4
5'-CACTGGGCACCTCCCTTC-3'              (SEQ ID NO:79)

reverse PCR primer 1
5'-CTCCAGGCTGGTCTCCAAGTCCTTCC-3'      (SEQ ID NO:80)

reverse PCR primer 2
5'-TCCCTGTTGGACTCTGCAGCTTCC-3'        (SEQ ID NO:81)

reverse PCR primer 3
5'-CTTCGCTGGGAAGAGTTTG-3'             (SEQ ID NO:82)
```

Additionally, a synthetic oligonucleotide hybridization probe was constructed from the consensus DNA44706 sequence which had the following nucleotide sequence

```
hybridization probe                   (SEQ ID NO:83)
5'-GTGCAACCAACAGATACAAACTCTTCCCAGCGAAGAA
GCTGAAAAGCGTC-3'
```

In order to screen several libraries for a source of a full-length clone, DNA from the libraries was screened by PCR amplification with one of the PCR primer pairs identified above. A positive library was then used to isolate clones encoding the PRO545 gene using the probe oligonucleotide and one of the PCR primers. RNA for construction of the cDNA libraries was isolated from human placenta tissue (LIB90).

DNA sequencing of the clones isolated as described above gave the full-length DNA sequence for PRO545 [herein designated as UNQ346 (DNA49624-1279)] (SEQ ID NO:73) and the derived protein sequence for PRO545.

The entire nucleotide sequence of UNQ346 (DNA49624-1279) is shown in FIG. 29 (SEQ ID NO:73). Clone UNQ346 (DNA49624-1279) contains a single open reading frame with an apparent translational initiation site at nucleotide positions 311–313 and ending at the stop codon at nucleotide positions 2516–2518 (FIG. 29). The predicted polypeptide precursor is 735 amino acids long (FIG. 30). The full-length PRO545 protein shown in FIG. 30 has an estimated molecular weight of about 80,177 daltons and a pI of about 7.08. Important regions of the PRO545 amino acid sequence include the signal peptide, corresponding to amino acids 1–28, five potential N-glycosylation sites, from about amino acid 111–114, amino acids 146–149, amino acids 348–351, amino acids 449–452, and amino acids 648–651, and a neutral zinc metallopeptidase, zinc-binding region signature sequence, from about amino acids 344–353. Clone UNQ346 (DNA49624-1279) has been deposited with ATCC and is assigned ATCC deposit no. 209655.

Example 14

Isolation of cDNA Clones Encoding Human PRO617

A consensus sequence was obtained relative to a variety of EST sequences as described in Example 1 above, wherein the consensus sequence obtained is herein designated DNA42798. Based on the DNA42798 sequence, oligonucleotides were synthesized: 1) to identify by PCR a cDNA library that contained the sequence of interest, and 2) for use as probes to isolate a clone of the full-length coding sequence for PRO617.

A pair of PCR primers (forward and reverse) were synthesized:

```
forward PCR primer
5'-ACGGGCACACTGGATCCCAAATG-3'         (SEQ ID NO:86)

reverse PCR primer
5'-GGTAGAGATGTAGAAGGGCAAGCAAGACC-3'   (SEQ ID NO:87)
```

Additionally, a synthetic oligonucleotide hybridization probe was constructed from the consensus DNA42798 sequence which had the following nucleotide sequence

```
hybridization probe                   (SEQ ID NO:88)
5'-GCTCCCTACCCGTGCAGGTTTCTTCATTTGTTCCTTT
AACCAGTATGCCG-3'
```

In order to screen several libraries for a source of a full-length clone, DNA from the libraries was screened by PCR amplification with the PCR primer pair identified above. A positive library was then used to isolate clones encoding the PRO617 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO617 [herein designated as UNQ353 (DNA48309-1280)] (SEQ ID NO:1) and the derived protein sequence for PRO617.

The entire nucleotide sequence of UNQ353 (DNA48309-1280) is shown in FIG. 32 (SEQ ID NO:84). Clone UNQ353 (DNA48309-1280) contains a single open reading frame with an apparent translational initiation site at nucleotide positions 723–725 and ending at the stop codon at nucleotide positions 924–926 (FIG. 32). The predicted polypeptide precursor is 67 amino acids long (FIG. 33). The full-length PRO617 protein shown in FIG. 33 has an estimated molecular weight of about 6,981 daltons and a pI of about 7.47. Analysis of the PRO617 amino acid sequence also evidences the existence of a putative signal peptide from about amino acid 15 to about amino acid 27 and a putative protein kinase C phosphorylation site from about amino acid 41 to about amino acid 43. Clone UNQ353 (DNA48309-1280) has been deposited on Mar. 5, 1998 with ATCC and is assigned ATCC deposit no. 209656.

Analysis of the amino acid sequence of the full-length PRO617 polypeptide suggests that it possesses significant homology to the CD24 protein, thereby indicating that PRO617 may be a novel CD24 homolog. More specifically, an analysis of the Dayhoff database (version 35.45 SwissProt 35) evidenced significant homology between the PRO617 amino acid sequence and the following Dayhoff sequences, CD24_HUMAN, CD24_MOUSE, S15785, CD24_RAT, VGE BPG4, MSE5_HUMAN, HSMHC3W36A_2, MLU15184_8, P R85075, SEPL_HUMAN and MTCY63_13.

Example 15

Isolation of cDNA Clones Encoding Human PRO700

A consensus sequence was obtained relative to a variety of EST sequences as described in Example 1 above, wherein the consensus sequence obtained is herein designated DNA30837. Based on the DNA30837 consensus sequence, oligonucleotides were synthesized: 1) to identify by PCR a cDNA library that contained the sequence of interest, and 2) for use as probes to isolate a clone of the full-length coding sequence for PRO700.

Forward and reverse PCR primers were synthesized:

```
forward PCR primer 1
5'-ATGTTCTTCGCGCCCTGGTG-3'         (SEQ ID NO:91)

forward PCR primer 2
5'-CCAAGCCAACACACTCTACAG-3'        (SEQ ID NO:92)

reverse PCR primer 1
5'-AAGTGGTCGCCTTGTGCAACGTGC-3'     (SEQ ID NO:93)

reverse PCR primer 2
5'-GGTCAAAGGGGATATATCGCCAC-3'      (SEQ ID NO:94)
```

Additionally, a synthetic oligonucleotide hybridization probe was constructed from the consensus DNA30837 sequence which had the following nucleotide sequence

```
hybridization probe                                (SEQ ID NO:95)
5'-GCATGGAAGATGCCAAAGTCTATGTGGCTAAAGTGGA
CTGCACGGCCCA-3'
```

In order to screen several libraries for a source of a full-length clone, DNA from the libraries was screened by PCR amplification with one of the PCR primer pairs identified above. A positive library was then used to isolate clones encoding the PRO700 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO700 [herein designated as UNQ364 (DNA46776-1284)] (SEQ ID NO:89) and the derived protein sequence for PRO700.

The entire nucleotide sequence of UNQ364 (DNA46776-1284) is shown in FIG. 34 (SEQ ID NO:89). Clone UNQ364 (DNA46776-1284) contains a single open reading frame with an apparent translational initiation site at nucleotide positions 33–35 and ending at the stop codon at nucleotide positions 1329–1331 (FIG. 34). The predicted polypeptide precursor is 432 amino acids long (FIG. 35). The full-length PRO700 protein shown in FIG. 35 has an estimated molecular weight of about 47,629 daltons and a pI of about 5.90. Important regions of the amino acid sequence of PRO700 include the signal peptide, corresponding to amino acids from about 1 to 33, regions homologous to disulfide isomerase, corresponding to amino acids from about 82–99, 210–255, and 345–360, a tyrosine kinase phosphorylation site, corresponding to amino acids from about 143–151, and an endoplasmic reticulum targeting sequence, corresponding to amino acids from about 429–432. Clone UNQ364 (DNA46776-1284) has been deposited with ATCC and is assigned ATCC Deposit No. 209721.

Example 16

Isolation of cDNA Clones Encoding Human PRO702

A consensus sequence was obtained relative to a variety of EST sequences as described in Example 1 above, wherein the consensus sequence obtained is herein designated DNA36623. Based on the DNA36623 consensus sequence, oligonucleotides were synthesized: 1) to identify by PCR a cDNA library that contained the sequence of interest, and 2) for use as probes to isolate a clone of the full-length coding sequence for PRO702.

A pair of PCR primers (forward and reverse) were synthesized:

```
forward PCR primer (36623.f1)
5'-CGCTGACTATGTTGCCAAGAGTGG-3'     (SEQ ID NO:98)

reverse PCR primer (36623.r1)
5'-GATGATGGAGGCTCCATACCTCAG-3'     (SEQ ID NO:99)
```

Additionally, a synthetic oligonucleotide hybridization probe was constructed from the consensus DNA36623 sequence which had the following nucleotide sequence

```
hybridization probe (36623.p1)
5'-GTGTTCATTGGCGTGAATGACCTTGAAAGGGAGGGACAGTACATGTTCAC-3'   (SEQ ID NO:100)
```

In order to screen several libraries for a source of a full-length clone, DNA from the libraries was screened by PCR amplification with the PCR primer pair identified above. A positive library was then used to isolate clones encoding the PRO702 gene using the probe oligonucleotide and one of the PCR primers. RNA for construction of the cDNA libraries was isolated from human fetal liver tissue (LIB229).

DNA sequencing of the clones isolated as described above gave the full-length DNA sequence for PRO702 [herein designated as UNQ366 (DNA50980-1286)] (SEQ ID NO:96) and the derived protein sequence for PRO702.

The entire nucleotide sequence of UNQ366 (DNA50980-1286) is shown in FIG. 36 (SEQ ID NO:96). Clone UNQ366 (DNA50980-1286) contains a single open reading frame with an apparent translational initiation site at nucleotide positions 22–24 and ending at the stop codon at nucleotide positions 853–855 (FIG. 36). The predicted polypeptide precursor is 277 amino acids long (FIG. 37). The full-length PRO702 protein shown in FIG. 37 has an estimated molecular weight of about 30,645 daltons and a pI of about 7.47. Analysis of the full-length native PRO702 amino acid sequence evidences the presence of a putative signal peptide from about amino acid 1 to about amino acid 25, potential N-glycosylation sites from about amino acid 230 to about amino acid 233 and from about amino acid 258 to about amino acid 261 and a C-type lectin domain signature sequence from about amino acid 248 to about amino acid 270. Clone UNQ366 (DNA50980-1286) has been deposited with ATCC on Mar. 31, 1998 and is assigned ATCC deposit no. 209717.

Analysis of the amino acid sequence of the full-length PRO702 polypeptide suggests that it possesses significant sequence similarity to the conglutinin protein, thereby indicating that PRO702 may be a novel conglutinin homolog. More specifically, an analysis of the Dayhoff database (version 35.45 SwissProt 35) evidenced significant homology between the PRO702 amino acid sequence and the following Dayhoff sequences, S32436, P_R75642, P_W18780, P_W18781, A53330, AC002528_1, CA21_HUMAN, CA14_HUMAN and A61262.

Example 17

Isolation of cDNA Clones Encoding Human PRO703

A consensus sequence was obtained relative to a variety of EST sequences as described in Example 1 above, wherein the consensus sequence obtained is herein designated DNA43047. Based on the DNA43047 consensus sequence, oligonucleotides were synthesized: 1) to identify by PCR a cDNA library that contained the sequence of interest, and 2) for use as probes to isolate a clone of the full-length coding sequence for PRO703.

Forward and reverse PCR primers were synthesized:

```
forward PCR primer
5'-GAGAGCCATGGGGCTCCACCTG-3'           (SEQ ID NO:103)
```

-continued
```
reverse PCR primer 1
5'-GGAGAATGTGGCCACAAC-3'               (SEQ ID NO:104)

reverse PCR primer 2
5'-GCCCTGGCACAGTGACTCCATAGACG-3'       (SEQ ID NO:105)

reverse PCR primer 3
5'-ATCCACTTCAGCGGACAC-3'               (SEQ ID NO:106)
```

Additionally, a synthetic oligonucleotide hybridization probe was constructed from the consensus DNA40654 sequence which had the following nucleotide sequence

```
hybridization probe                    (SEQ ID NO:107)
5'-CCAGTGCCAGGATACCTCTCTTCCCCCCAGAGCATAACAGACACG-3'
```

In order to screen several libraries for a source of a full-length clone, DNA from the libraries was screened by PCR amplification with one of the PCR primer pairs identified above. A positive library was then used to isolate clones encoding the PRO703 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO703 [herein designated as UNQ367 (DNA50913-1287)] (SEQ ID NO:101) and the derived protein sequence for PRO703.

The entire nucleotide sequence of UNQ367 (DNA50913-1287) is shown in FIG. 38 (SEQ ID NO:101). Clone UNQ367 (DNA50913-1287) contains a single open reading frame with an apparent translational initiation site at nucleotide positions 115–117 and ending at the stop codon at nucleotide positions 2305–2307 (FIG. 38). The predicted polypeptide precursor is 730 amino acids long (FIG. 39). The full-length PRO703 protein shown in FIG. 39 has an estimated molecular weight of about 78,644 daltons, and a pI of about: 7.65. Important regions of the PRO703 amino acid sequence include the signal peptide, a cAMP- and cGMP-dependent protein kinase phosphorylation site, a CUB domain protein motif, N-glycosylation sites and a putative AMP-binding domain signature. Clone UNQ367 (DNA50913-1287) has been deposited with ATCC and is assigned ATCC deposit no. 209716.

Example 18

Isolation of cDNA Clones Encoding Human PRO705

A consensus sequence was obtained relative to a variety of EST sequences as described in Example 1 above, wherein the consensus sequence obtained is herein designated DNA43437. Based on the DNA43437 consensus sequence, oligonucleotides were synthesized: 1) to identify by PCR a cDNA library that contained the sequence of interest, and 2) for use as probes to isolate a clone of the full-length coding sequence for PRO705.

A pair of PCR primers (forward and reverse) were synthesized:

```
forward PCR primer
5'-AAGCGTGACAGCGGGCACGTC-3'        (SEQ ID NO:110)

reverse PCR primer
5'-TGCACAGTCTCTGCAGTGCCCAGG-3'     (SEQ ID NO:111)
```

Additionally, a synthetic oligonucleotide hybridization probe was constructed from the consensus DNA43437 sequence which had the following nucleotide sequence

```
hybridization probe (43437.p1)     (SEQ ID NO:112)
5'-GAATGCTGGAACGGGCACAGCAAAGCCAGATACTTGCCTG-3'
```

In order to screen several libraries for a source of a full-length clone, DNA from the libraries was screened by PCR amplification with the PCR primer pair identified above. A positive library was then used to isolate clones encoding the PRO705 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO705 [herein designated as UNQ369 (DNA50914-1289)] (SEQ ID NO:108) and the derived protein sequence for PRO705.

The entire nucleotide sequence of UNQ369 (DNA50914-1289) is shown in FIG. 40 (SEQ ID NO:108). Clone UNQ369 (DNA50914-1289) contains a single open reading frame with an apparent translational initiation site at nucleotide positions 566–568 and ending at the stop codon at nucleotide positions 2231–2233 (FIG. 40). The predicted polypeptide precursor is 555 amino acids long (FIG. 41). The full-length PRO705 protein shown in FIG. 41 has an estimated molecular weight of about 62,736 daltons and a pI of about 5.36. Analysis of the full-length PRO705 sequence as shown in FIG. 41 evidences the presence of the following: a signal peptide from about amino acid 1 to about amino acid 23, a eukaryotic DNA topoisomerase I active site from about amino acid 418 to about amino acid 436, and various regions that show homology to various glypican proteins from about amino acid 237 to about amino acid 279, about amino acid 421 to about amino acid 458, about amino acid 53 to about amino acid 74, about amino acid 466 to about amino acid 504, about amino acid 308 to about amino acid 355, about amino acid 104 to about amino acid 156 and about amino acid 379 to about amino acid 410. Clone UNQ369 (DNA50914-1289) has been deposited with ATCC on Mar. 31, 1998 and is assigned ATCC deposit no. 209722.

Analysis of the amino acid sequence of the full-length PRO705 polypeptide suggests that it possesses significant sequence similarity to the K-glypican protein, thereby indicating that PRO705 may be a novel glypican protein family member. More specifically, an analysis of the Dayhoff database (version 35.45 SwissProt 35) evidenced significant homology between the PRO705 amino acid sequence and the following Dayhoff sequences, GPCK_MOUSE, GLYP_CHICK, GLYP_RAT, GLYP_HUMAN, GPC2_RAT, GPC5_HUMAN, GPC3_HUMAN, GPC3_RAT, P_R30168 and CEC03H12__2.

Example 19

Isolation of cDNA Clones Encoding Human PRO708

A consensus sequence was obtained relative to a variety of EST sequences as described in Example 1 above, wherein the consensus sequence obtained is herein designated DNA34024. Based on the DNA34024 consensus sequence, oligonucleotides were synthesized: 1) to identify by PCR a cDNA library that contained the sequence of interest, and 2) for use as probes to isolate a clone of the full-length coding sequence for PRO708.

A pair of PCR primers (forward and reverse) were synthesized:

```
forward PCR primer
5'-CCCAACCCAACTGTTTACCTCTGG-3'     (SEQ ID NO:115)

reverse PCR primer
5'-CTCTCTGAGTGTACATCTGTGTGG-3'     (SEQ ID NO:116)
```

Additionally, a synthetic oligonucleotide hybridization probe was constructed from the consensus DNA34024 sequence which had the following nucleotide sequence

```
hybridization probe
5'-GCCACCCTACCTCAGAAACTGAAGGAGGTTGGNTATTCAACGCATATGGTCGG-3'  (SEQ ID NO:117)
```

In order to screen several libraries for a source of a full-length clone, DNA from the libraries was screened by PCR amplification with the PCR primer pair identified above. A positive library was then used to isolate clones encoding the PRO708 gene using the probe oligonucleotide and one of the PCR primers. RNA for construction of the cDNA libraries was isolated from human bone marrow tissue (LIB255).

DNA sequencing of the clones isolated as described above gave the full-length DNA sequence for PRO708 [herein designated as UNQ372 (DNA48296-1292)] (SEQ ID NO:113) and the derived protein sequence for PRO708.

The entire nucleotide sequence of UNQ372 (DNA48296-1292) is shown in FIGS. 42A–B (SEQ ID NO:113). Clone UNQ372 (DNA48296-1292) contains a single open reading frame with an apparent translational initiation site at nucleotide positions 891–893 and ending at the stop codon at nucleotide positions 2436–2438 (FIGS. 42A–B). The predicted polypeptide precursor is 515 amino acids long (FIG. 43). The full-length PRO708 protein shown in FIG. 43 has an estimated molecular weight of about 56,885 daltons and a pI of about 6.49. Analysis of the PRO708 amino acid sequence shown in FIG. 43 (SEQ ID NO:114) evidences the existence of a putative signal peptide at about amino acid 1 to about amino acid 37, putative sulfatase signature sequences at about amino acid 120 to about amino acid 132 and about amino acid 168 to about amino acid 177, a putative tyrosine kinase phosphorylation site from about amino acid 163 to about amino acid 169 and potential N-glycosylation sites from about amino acid 157 to about amino acid 160, about amino acid 306 to about amino acid 309 and about amino acid 318 to about amino acid 321.

Clone UNQ372 (DNA48296-1292) has been deposited with ATCC on Mar. 11, 1998 and is assigned ATCC deposit no. 209668.

Analysis of the amino acid sequence of the full-length PRO708 polypeptide suggests that it possesses significant homology to the aryl sulfatase proteins, thereby indicating that PRO708 may be a novel aryl sulfatase homolog. More specifically, an analysis of the Dayhoff database (version 35.45 SwissProt 35) evidenced significant homology between the PRO708 amino acid sequence and the following Dayhoff sequences, ARSB_HUMAN, CELC54D2_2, G02857, STS_HUMAN, I37186, I37187, GEN12648, CELD1014_7, GA6S_HUMAN and SPHM_HUMAN.

Example 20

Isolation of cDNA Clones Encoding Human PRO320

A consensus sequence was obtained relative to a variety of EST sequences as described in Example 1 above, wherein the consensus sequence obtained is herein designated DNA28739. Based on the DNA28739 consensus sequence, oligonucleotides were synthesized: 1) to identify by PCR a cDNA library that contained the sequence of interest, and 2) for use as probes to isolate a clone of the full-length coding sequence for PRO320.

A pair of PCR primers (forward and reverse) were synthesized:

```
forward PCR primer
5'-CCTCAGTGGCCACATGCTCATG-3'    (SEQ ID NO:120)

reverse PCR primer
5'-GGCTGCACGTATGGCTATCCATAG-3'  (SEQ ID NO:121)
```

Additionally, a synthetic oligonucleotide hybridization probe was constructed from the consensus DNA28739 sequence which had the following nucleotide sequence

```
hybridization probe
5'-GATAAACTGTCAGTACAGCTGTGAAGACACAGAAGAAGGGCCACAGTGCC-3'   (SEQ ID NO:122)
```

In order to screen several libraries for a source of a full-length clone, DNA from the libraries was screened by PCR amplification with the PCR primer pair identified above. A positive library was then used to isolate clones encoding the PRO320 gene using the probe oligonucleotide and one of the PCR primers. RNA for construction of the cDNA libraries was isolated from human fetal lung tissue (LIB25).

DNA sequencing of the clones isolated as described above gave the full-length DNA sequence for PRO320 [herein designated as UNQ281 (DNA32284-1307)] (SEQ ID NO:118) and the derived protein sequence for PRO320.

The entire nucleotide sequence of UNQ281 (DNA32284-1307) is shown in FIG. 44 (SEQ ID NO:118). Clone UNQ281 (DNA32284-1307) contains a single open reading frame with an apparent translational initiation site at nucleotide positions 135–137 and ending at the stop codon at nucleotide positions 1149–1151 (FIG. 44). The predicted polypeptide precursor is 338 amino acids long (FIG. 45). The full-length PRO320 protein shown in FIG. 45 has an estimated molecular weight of about 37,143 daltons and a pI of about 8.92. Important regions of the PRO320 amino acid sequence include the signal peptide, corresponding to amino acids 1–21, an EGF-like domain cysteine pattern signature, corresponding to amino acids 80–91, and three calcium-binding EGF-like domains, corresponding to amino acids 103–124, 230–151 and 185–206, respectively. Clone UNQ281 (DNA32284-1307) has been deposited with ATCC and is assigned ATCC deposit no. 209670.

Example 21

Isolation of cDNA Clones Encoding Human PRO324

A consensus sequence was obtained relative to a variety of EST sequences as described in Example 1 above, wherein the consensus sequence obtained is herein designated DNA34347. Based on the DNA34347 consensus sequence, oligonucleotides were synthesized: 1) to identify by PCR a cDNA library that contained the sequence of interest, and 2) for use as probes to isolate a clone of the full-length coding sequence for PRO324.

PCR primers (forward and reverse) were synthesized:

```
forward PCR primer 1
5'-GCAATGAACTGGGAGCTGC-3'        (SEQ ID NO:125)

forward PCR primer 2
5'-CTGTGAATAGCATCCTGGG-3'        (SEQ ID NO:126)

forward PCR primer 3
5'-CTTTTCAAGCCACTGGAGGG-3'       (SEQ ID NO:127)

reverse PCR primer 1
5'-CTGTAGACATCCAAGCTGGTATCC-3'   (SEQ ID NO:128)

reverse PCR primer 2
5'-AAGAGTCTGCATCCACACCACTC-3'    (SEQ ID NO:129)
```

Additionally, a synthetic oligonucleotide hybridization probe was constructed from the consensus DNA34347 sequence which had the following nucleotide sequence

```
hybridization probe                 (SEQ ID NO:130)
5'-ACCTGACGCTACTATGGGCCGAGTGGCAGGGACGACGCCCAGAATG-3'
```

In order to screen several libraries for a source of a full-length clone, DNA from the libraries was screened by PCR amplification with one of the PCR primer pairs identified above. A positive library was then used to isolate clones encoding the PRO324 gene using the probe oligonucleotide and one of the PCR primers. RNA for construction of the cDNA libraries was isolated from human fetal liver tissue (LIB6).

DNA sequencing of the clones isolated as described above gave the full-length DNA sequence for PRO324 [herein designated as UNQ285 (DNA36343-1310)] (SEQ ID NO:123) and the derived protein sequence for PRO324.

The entire nucleotide sequence of UNQ285 (DNA36343-1310) is shown in FIG. 46 (SEQ ID NO:123). Clone UNQ285 (DNA36343-1310) contains a single open reading frame with an apparent translational initiation site at nucleotide positions 144–146 and ending at the stop codon at nucleotide positions 1011–1013 (FIG. 46). The predicted polypeptide precursor is 289 amino acids long (FIG. 47). The full-length PRO324 protein shown in FIG. 47 has an estimated molecular weight of about 32,268 daltons and a pI of about 9.21. Analysis of the PRO324 polypeptide sequence shown in FIG. 47 (SEQ ID NO:124) evidence the presence of the following: a signal peptide from about amino acid 1 to about amino acid 31, a transmembrane domain from about amino acid 136 to about amino acid 157, tyrosine kinase phosphorylation sites from about amino acid 106 or about amino acid 107 to about amino acid 113 and regions that are homologous to short-chain alcohol dehydrogenase regions from about amino acid 80 to about amino acid 90, from about amino acid 131 to about amino acid 168, from about amino acid 1 to about amino acid 13 and from about amino acid 176 to about amino acid 185. Clone UNQ285 (DNA36343-1310) has been deposited with ATCC on Mar. 30, 1998 and is assigned ATCC deposit no. 209718.

Analysis of the amino acid sequence of the full-length PRO324 polypeptide suggests that it possesses significant sequence similarity to oxidoreductases, thereby indicating that PRO324 may be a novel oxidoreductase homolog. More specifically, an analysis of the Dayhoff database (version 35.45 SwissProt 35) evidenced significant homology between the PRO324 amino acid sequence and the following Dayhoff sequences, B61209, A69965, YQJQ_BACSU, D69930, S76124, FABG_ECOLI, C70023, S77280, FABG_VIBHA and MTV013_6.

Example 22

Isolation of cDNA Clones Encoding Human PRO351

A consensus sequence was obtained relative to a variety of EST sequences as described in Example 1 above, wherein the consensus sequence obtained is herein designated DNA35950. Based on the DNA35950 consensus sequence, oligonucleotides were synthesized: 1) to identify by PCR a cDNA library that contained the sequence of interest, and 2) for use as probes to isolate a clone of the full-length coding sequence for PRO351.

Forward and reverse PCR primers were synthesized:

```
forward PCR primer
5'-CCTGTGCTGTGCCTCGAGCCTGAC-3'    (SEQ ID NO:133)

reverse PCR primer
5'-GTGGGCAGCAGTTAGCACCGCCTC-3'    (SEQ ID NO:134)
```

Additionally, a synthetic oligonucleotide hybridization probe was constructed from the consensus DNA35950 sequence which had the following nucleotide sequence

```
hybridization probe                (SEQ ID NO:135)
5'-GGCTGGCATCATCAGCTTTGCATCAAGCTGTGCCCAGGAGGACGC-3'
```

In order to screen several libraries for a source of a full-length clone, DNA from the libraries was screened by PCR amplification with one of the PCR primer pairs identified above. A positive library was then used to isolate clones encoding the PRO351 gene using the probe oligonucleotide and one of the PCR primers. RNA for construction of the cDNA libraries was isolated from human fetal liver tissue (LIB230).

DNA sequencing of the clones isolated as described above gave the full-length DNA sequence for PRO351 [herein designated as UNQ308 (DNA40571-1315)] (SEQ ID NO:131) and the derived protein sequence for PRO351.

The entire nucleotide sequence of UNQ308 (DNA40571-1315) is shown in FIG. 48 (SEQ ID NO:131). Clone UNQ308 (DNA40571-1315) contains two open reading frames with an apparent translational initiation site at nucleotide positions 189–191 and a second open reading frame beginning at nucleotide 470, with the two open reading frames ending at the stop codons at nucleotide positions 363–365 and 2009–2011, respectively (FIG. 48). The predicted polypeptide precursor is 571 amino acids long (FIG. 49). Important regions of the amino acid sequence of PRO351 include the signal peptide, regions having sequence similarity to serine proteases of the trypsin family, two N-glycosylation sites, and three Kringle domains. Clone UNQ308 (DNA40571-1315) has been deposited with ATCC and is assigned ATCC deposit no. 209784.

Example 23

Isolation of cDNA Clones Encoding Human PRO352

A consensus sequence was obtained relative to a variety of EST sequences as described in Example 1 above, wherein the consensus sequence obtained is herein designated DNA36950. Based on the DNA36950 consensus sequence, oligonucleotides were synthesized: 1) to identify by PCR a cDNA library that contained the sequence of interest, and 2) for use as probes to isolate a clone of the full-length coding sequence for PRO352.

PCR primers (forward and reverse) were synthesized:

```
forward PCR primer 1
5'-CTGGCACAGCTCAACCTCATCTGG-3'    (SEQ ID NO:138)

forward PCR primer 2
5'-GCTGTCTGTCTGTCTCATTG-3'        (SEQ ID NO:139)

forward PCR primer 3
5'-GGACACAGTATACTGACCAC-3'         (SEQ ID NO:140)

reverse PCR primer 1
5'-TGCGAACCAGGCAGCTGTAAGTGC-3'    (SEQ ID NO:141)

reverse PCR primer 2
5'-TGGAAGAAGAGGGTGGTGATGTGG-3'    (SEQ ID NO:142)
```

Additionally, a synthetic oligonucleotide hybridization probe was constructed from the consensus DNA36950 sequence which had the following nucleotide sequence

```
hybridization probe                (SEQ ID NO:143)
5'-CAGCTGACAGACACCAAACAGCTGGTGCACAGTTTCACCGAAGGC-3'
```

In order to screen several libraries for a source of a full-length clone, DNA from the libraries was screened by PCR amplification with the PCR primer pair identified above. A positive library was then used to isolate clones encoding the PRO352 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO352 [herein designated as UNQ309 (DNA41386-1316)] (SEQ ID NO:136) and the derived protein sequence for PRO352.

The entire nucleotide sequence of UNQ309 (DNA41386-1316) is shown in FIG. 50 (SEQ ID NO:136). Clone UNQ309 (DNA41386-1316) contains a single open reading frame with an apparent translational initiation site at nucleotide positions 152–154 and ending at the stop codon at nucleotide positions 1100–1102 (FIG. 50). The predicted polypeptide precursor is 316 amino acids long (FIG. 51). The full-length PRO352 protein shown in FIG. 2 has an estimated pI of about 4.62. Analysis of the full-length PRO352 sequence evidences the presence of a signal peptide from about amino acid 1 to about amino acid 28, a transmembrane domain from about amino acid 251 to about amino acid 270, potential N-glycosylation sites from about amino acid 91 to about amino acid 94, about amino acid 104 to about amino acid 107, about amino acid 189 to about amino acid 192 and about amino acid 215 to about amino acid 218 and a region having homology to immunoglobulins and MHC from about amino acid 217 to about amino acid 234. Clone UNQ309 (DNA41386-1316) has been deposited with ATCC on Mar. 26, 1998 and is assigned ATCC deposit no. 209703.

Analysis of the amino acid sequence of the full-length PRO352 polypeptide suggests that it possesses significant sequence similarity to the butyrophilin protein, thereby indicating that PRO352 is a novel butyrophilin homolog. More specifically, an analysis of the Dayhoff database (version 35.45 SwissProt 35) evidenced significant homology between the PRO352 amino acid sequence and the following Dayhoff sequences, BUTY_HUMAN, HSB73__1, GGCD80__1, I46690, A33_HUMAN, P_R67988, CD86_MOUSE, P_R71360, B39371 and D50558__1.

Example 24

Isolation of cDNA Clones Encoding Human PRO381

A consensus sequence was obtained relative to a variety of EST sequences as described in Example 1 above, wherein the consensus sequence obtained is herein designated DNA39651. Based on the DNA39651 consensus sequence, oligonucleotides were synthesized: 1) to identify by PCR a cDNA library that contained the sequence of interest, and 2) for use as probes to isolate a clone of the full-length coding sequence for PRO381.

A pair of PCR primers (forward and reverse) were synthesized:

```
forward PCR primer
5'-CTTTCCTTGCTTCAGCAACATGAGGC-3'    (SEQ ID NO:146)

reverse PCR primer
5'-GCCCAGAGCAGGAGGAATGATGAGC-3'     (SEQ ID NO:147)
```

Additionally, a synthetic oligonucleotide hybridization probe was constructed from the consensus DNA39651 sequence which had the following nucleotide sequence

```
hybridization probe
5'-GTGGAACGCGGTCTTGACTCTGTTCGTCACTTCTTTGATTGGGGCTTTG-3'   (SEQ ID NO:148)
```

In order to screen several libraries for a source of a full-length clone, DNA from the libraries was screened by PCR amplification with the PCR primer pair identified above. A positive library was then used to isolate clones encoding the PRO381 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO381 [herein designated as UNQ322 (DNA44194-1317)] (SEQ ID NO:144) and the derived protein sequence for PRO381.

The entire nucleotide sequence of UNQ322 (DNA44194-1317) is shown in FIG. 52 (SEQ ID NO:144). Clone UNQ322 (DNA44194-1317) contains a single open reading frame with an apparent translational initiation site at nucleotide positions 174–176 and ending at the stop codon at nucleotide positions 807–809 (FIG. 52). The predicted polypeptide precursor is 211 amino acids long (FIG. 53). The full-length PRO381 protein shown in FIG. 53 has an estimated molecular weight of about 24,172 daltons and a pI of about 5.99. Analysis of the full-length PRO381 polypeptide shown in FIG. 53 (SEQ ID NO:145) evidences the presence of the following: a signal peptide from about amino acid 1 to about amino acid 20, a potential N-glycosylation site from about amino acid 176 to about amino acid 179, potential casein kinase II phosphorylation sites from about amino acid 143 to about amino acid 146, from about amino acid 156 to about amino acid 159, from about amino acid 178 to about amino acid 181, and from about amino acid 200 to about amino acid 203, an endoplasmic reticulum targeting sequence from about amino acid 208 to about amino acid 211, FKBP-type peptidyl-prolyl cis-trans isomerase sites from about amino acid 78 to about amino acid 114 and from about amino acid 118 to about amino acid 131, EF-hand calcium binding domains from about amino acid 191 to about amino acid 203, from about amino acid 184 to about amino acid 203 and from about amino acid 140 to about amino acid 159, and an S-100/ICaBP type calcium binding domain from about amino acid 183 to about amino acid 203. Clone UNQ322 (DNA44194-1317) has been deposited with ATCC on Apr. 28, 1998 and is assigned ATCC deposit no. 209808.

Analysis of the amino acid sequence of the full-length PRO381 polypeptide suggests that it possesses significant sequence similarity to FKBP immunophilin proteins, thereby indicating that PRO381 may be a novel FKBP immunophilin homolog. More specifically, an analysis of the Dayhoff database (version 35.45 SwissProt 35) evidenced significant homology between the PRO381 amino acid sequence and the following Dayhoff sequences, AF040252__1, I49669, P_R93551, S71238, CELC05C8__1, CEU27353__1, MIP_TRYCR, CEZC455__3, FKB4_HUMAN and I40718.

Example 25

Isolation of cDNA Clones Encoding Human PRO386

A consensus sequence was obtained relative to a variety of EST sequences as described in Example 1 above, wherein the consensus sequence obtained is herein designated DNA40674. Two proprietary Genentech EST sequences were employed in the consensus sequence assembly, wherein those EST sequences are herein designated DNA23350 (FIG. 56; SEQ ID NO:151) and DNA23536 (FIG. 57; SEQ ID NO:152). Based on the DNA40674 consensus sequence, oligonucleotides were synthesized: 1) to identify by PCR a cDNA library that contained the sequence of interest, and 2) for use as probes to isolate a clone of the full-length coding sequence for PRO386.

A pair of PCR primers (forward and reverse) were synthesized:

```
forward PCR primer
5'-ACGGAGCATGGAGGTCCACAGTAC-3'    (SEQ ID NO:153)

reverse PCR primer
5'-GCACGTTTCTCAGCATCACCGAC-3'     (SEQ ID NO:154)
```

Additionally, a synthetic oligonucleotide hybridization probe was constructed from the consensus DNA40674 sequence which had the following nucleotide sequence

```
hybridization probe
5'-CGCCTGCCCTGCACCTTCAACTCCTGCTACACAGTGAACCACAAACAGTT-3'    (SEQ ID NO:155)
```

In order to screen several libraries for a source of a full-length clone, DNA from the libraries was screened by PCR amplification with the PCR primer pair identified above. A positive library was then used to isolate clones encoding the PRO386 gene using the probe oligonucleotide and one of the PCR primers. RNA for construction of the cDNA libraries was isolated from human fetal brain tissue (LIB153).

DNA sequencing of the clones isolated as described above gave the full-length DNA sequence for PRO386 [herein designated as UNQ326 (DNA45415-1318)] (SEQ ID NO:149) and the derived protein sequence for PRO386.

The entire nucleotide sequence of UNQ326 (DNA45415-1318) is shown in FIG. 54 (SEQ ID NO:149). Clone UNQ326 (DNA45415-1318) contains a single open reading frame with an apparent translational initiation site at nucleotide positions 146–148 and ending at the stop codon at nucleotide positions 791–793 (FIG. 54). The predicted polypeptide precursor is 215 amino acids long (FIG. 55). The full-length PRO386 protein shown in FIG. 55 has an estimated molecular weight of about 24,326 daltons and a pI of about 6.32. Analysis of the full-length PRO386 sequence shown in FIG. 55 (SEQ ID NO:150) evidences the presence of the following: a signal peptide from about amino acid 1 to about amino acid 20, a transmembrane domain from about amino acid 161 to about amino acid 179, an immunoglobulin-like fold from about amino acid 83 to about amino acid 127 and potential N-glycosylation sites from about amino acid 42 to about amino acid 45, from about amino acid 66 to about amino acid 69 and from about amino acid 74 to about amino acid 77. Clone UNQ326 (DNA45415-1318) has been deposited with ATCC on Apr. 28, 1998 and is assigned ATCC deposit no. 209810.

Analysis of the amino acid sequence of the full-length PRO386 polypeptide suggests that it possesses significant sequence similarity to the sodium channel beta-2 subunit, thereby indicating that PRO386 is a novel homolog thereof. More specifically, an analysis of the Dayhoff database (version 35.45 SwissProt 35) evidenced significant homology between the PRO386 amino acid sequence and the following Dayhoff sequences, A57843, MYP0_HUMAN, GEN14531, JC4024, HS46KDA_1, HSU90716_1, D86996_2, MUSIGLVD_1, DMU42768_1 and S19247.

Example 26

Isolation of cDNA Clones Encoding Human PRO540

A consensus sequence was obtained relative to a variety of EST sequences as described in Example 1 above, wherein the consensus sequence obtained is herein designated DNA39631. Based on the DNA39631 consensus sequence, oligonucleotides were synthesized: 1) to identify by PCR a cDNA library that contained the sequence of interest, and 2) for use as probes to isolate a clone of the full-length coding sequence for PRO540.

Forward and reverse PCR primers were synthesized:

```
forward PCR primer
```

```
                       -continued
5'-CTGGGGCTACACACGGGGTGAGG-3'     (SEQ ID NO:158)

reverse PCR primer
5'-GGTGCCGCTGCAGAAAGTAGAGCG-3'    (SEQ ID NO:159)
```

Additionally, a synthetic oligonucleotide hybridization probe was constructed from the consensus DNA40654 sequence which had the following nucleotide sequence

```
hybridization probe                      (SEQ ID NO:160)
5'-GCCCCAAATGAAAACGGGCCCTACTTCCTGGCCCTCCGCGAGATG-3'
```

In order to screen several libraries for a source of a full-length clone, DNA from the libraries was screened by PCR amplification with one of the PCR primer pairs identified above. A positive library was then used to isolate clones encoding the PRO540 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO540 [herein designated as UNQ341 (DNA44189-1322)] (SEQ ID NO:156) and the derived protein sequence for PRO540.

The entire nucleotide sequence of UNQ341 (DNA44189-1322) is shown in FIG. 58 (SEQ ID NO:156). Clone UNQ341 (DNA44189-1322) contains a single open reading frame with an apparent translational initiation site at nucleotide positions 21–23 and ending at the stop codon at nucleotide positions 1257–1259 (FIG. 58). The predicted polypeptide precursor is 412 amino acids long (FIG. 59). The full-length PRO540 protein shown in FIG. 59 has an estimated molecular weight of about 46,658 daltons and a pI of about 6.65. Important regions of the amino acid sequence of PRO540 include the signal peptide, potential N-glycosylation sites, a potential lipid substrate binding site, a sequence typical of lipases and serine proteins, and a beta-transducin family Trp-Asp repeat. Clone UNQ341 (DNA44189-1322) has been deposited with ATCC and is assigned ATCC deposit no. 209699.

Example 27

Isolation of cDNA Clones Encoding Human PRO615

A consensus sequence was obtained relative to a variety of EST sequences as described in Example 1 above, wherein the consensus sequence obtained is herein designated DNA42240. Based on the DNA42240 consensus sequence, oligonucleotides were synthesized: 1) to identify by PCR a cDNA library that contained the sequence of interest, and 2) for use as probes to isolate a clone of the full-length coding sequence for PRO615.

Forward and reverse PCR primers were synthesized:

```
forward PCR primer
5'-TGGTCTTCGCCTTGATCGTGTTCT-3'    (SEQ ID NO:163)

forward PCR primer
5'-GTGTACTGAGCGGCGGTTAG-3'        (SEQ ID NO:164)

reverse PCR primer
5'-CTGAAGGTGATGGCTGCCCTCAC-3'     (SEQ ID NO:165)

reverse PCR primer
5'-CCAGGAGGCTCATGGGAAAGTCC-3'     (SEQ ID NO:166)
```

Additionally, a synthetic oligonucleotide hybridization probe was constructed from the consensus DNA42240 sequence which had the following nucleotide sequence:

```
hybridization probe
5'-CCACGAGTCTAAGCAGATGTACTGCGTGTTCAACCGCAACGAGGATGCCT-3'    (SEQ ID NO:167)
```

In order to screen several libraries for a source of a full-length clone, DNA from the libraries was screened by PCR amplification with one of the PCR primer pairs identified above. A positive library was then used to isolate clones encoding the PRO615 gene using the probe oligonucleotide and one of the PCR primers. RNA for construction of the cDNA libraries was isolated from human bone marrow tissue (LIB255).

DNA sequencing of the clones isolated as described above gave the full-length DNA sequence for PRO615 [herein designated as UNQ352 (DNA48304-1323)] (SEQ ID NO:161) and the derived protein sequence for PRO615.

The entire nucleotide sequence of UNQ352 (DNA48304-1323) is shown in FIG. 60 (SEQ ID NO:161). Clone UNQ352 (DNA48304-1323) contains a single open reading frame with an apparent translational initiation site at nucleotide positions 51–53 and ending at the stop codon at nucleotide positions 723–725 (FIG. 60). The predicted polypeptide precursor is 224 amino acids long (FIG. 61). The full-length PRO615 protein shown in FIG. 61 has an estimated molecular weight of about 24,810 daltons and a pI of about 4.75. Important regions of the amino acid sequence of PRO615 include a type II transmembrane domain, corresponding to about amino acids 24–43, other transmembrane domains, corresponding to about amino acids 74–90, 108–126, and 145–161, respectively, and a potential N-glycosylation site, corresponding to about amino acids 97–100. Clone UNQ352 (DNA48304-1323) has been deposited with ATCC and is assigned ATCC deposit no. 209811.

Example 28

Isolation of cDNA Clones Encoding Human PRO618

A consensus sequence was obtained relative to a variety of EST sequences as described in Example 1 above, wherein the consensus sequence obtained is herein designated DNA30900. Based on the DNA30900 consensus sequence, oligonucleotides were synthesized: 1) to identify by PCR a cDNA library that contained the sequence of interest, and 2) for use as probes to isolate a clone of the full-length coding sequence for PRO618.

Forward and reverse PCR primers were synthesized:

```
forward PCR primer
5'-TAACAGCTGCCCACTGCTTCCAGG-3'    (SEQ ID NO:171)

reverse PCR primer
5'-TAATCCAGCAGTGCAGGCCGGG-3'      (SEQ ID NO:172)
```

Additionally, a synthetic oligonucleotide hybridization probe was constructed from the consensus DNA30900 sequence which had the following nucleotide sequence

```
hybridization probe
5'-ATGGCCTCCACGGTGCTGTGGACCGTGTTCCTGGGCAAGGTGTGGCAGAA-3'    (SEQ ID NO:173)
```

Screening of the above described library gave rise to the partial cDNA clone designated herein DNA35597 (SEQ ID NO:170). Extension of this sequence using repeated cycles of BLAST and phrap gave rise to a nucleotide sequence designated herein as DNA43335. Primers based upon the DNA43335 consensus sequence were then prepared as follows.

```
forward PCR primer
5'-TGCCTATGCACTGAGGAGGCAGAAG-3'   (SEQ ID NO:174)

reverse PCR primer
5'-AGGCAGGGACACAGAGTCCATTCAC-3'   (SEQ ID NO:175)
```

Additionally, a synthetic oligonucleotide hybridization probe was constructed from the consensus DNA43335 sequence which had the following nucleotide sequence hybridization probe
5'-AGTATGATTTGCCGTGCACCCAGGGCCAGTGGACGATCCAGAACAGGAGG-3' (SEQ ID NO:176)

In order to screen several libraries for a source of a full-length clone, DNA from the libraries was screened by PCR amplification with one of the PCR primer pairs identified above. A positive library was then used to isolate full length clones encoding the PRO618 gene using the second probe oligonucleotide and one of the second set of PCR primers. RNA for construction of the cDNA libraries was isolated from human fetal liver tissue (LIB229).

DNA sequencing of the clones isolated as described above gave the full-length DNA sequence for PRO618 [herein designated as UNQ354 (DNA49152-1324)] (SEQ ID NO:168) and the derived protein sequence for PRO618.

The entire nucleotide sequence of UNQ354 (DNA49152-1324) is shown in FIG. 62 (SEQ ID NO:168). Clone UNQ354 (DNA49152-1324) contains a single open reading frame with an apparent translational initiation site at nucleotide positions 73–75 and ending at the stop codon at nucleotide positions 2479–2481 (FIG. 62). The predicted polypeptide precursor is 802 amino acids long (FIG. 63). The full-length PRO618 protein shown in FIG. 63 has an estimated molecular weight of about 88,846 daltons and a pI of about 6.41. Important regions of the amino acid sequence of PRO618 include type II transmembrane domain, a sequence typical of a protease, trypsin family, histidine active site, multiple N-glycosylation sites, two sequences typical of a Kringle domain, two regions having sequence similarity to Kallikrein light chain, and a region having sequence similarity to low-density lipoprotein receptor. Clone UNQ354 (DNA49152-1324) has been deposited with ATCC and is assigned ATCC deposit no. 209813.

Example 29

Isolation of cDNA Clones Encoding Human PRO719

A consensus sequence was obtained relative to a variety of EST sequences as described in Example 1 above, wherein the consensus sequence obtained is herein designated DNA44851. Based on the DNA44851 consensus sequence, oligonucleotides were synthesized: 1) to identify by PCR a cDNA library that contained the sequence of interest, and 2) for use as probes to isolate a clone of the full-length coding sequence for PRO719.

A pair of PCR primers (forward and reverse) were synthesized:

forward PCR primer
5'-GTGAGCATGAGCGAGCCGTCCAC-3'  (SEQ ID NO:179)

reverse PCR primer
5'-GCTATTACAACGGTTCTTGCGGCAGC-3'  (SEQ ID NO:180)

Additionally, a synthetic oligonucleotide hybridization probe was constructed from the consensus DNA44851 sequence which had the following nucleotide sequence hybridization probe  (SEQ ID NO:181)
5'-TTGACTCTCTGGTGAATCAGGACAAGCCGAGTTTTGCCTTCCAG-3'

In order to screen several libraries for a source of a full-length clone, DNA from the libraries was screened by PCR amplification with the PCR primer pair identified above. A positive library was then used to isolate clones encoding the PRO719 gene using the probe oligonucleotide and one of the PCR primers. RNA for construction of the cDNA libraries was isolated from human placenta tissue (LIB90).

DNA sequencing of the clones isolated as described above gave the full-length DNA sequence for PRO719 [herein designated as UNQ387 (DNA49646-1327)] (SEQ ID NO:177) and the derived protein sequence for PRO719.

The entire nucleotide sequence of UNQ387 (DNA49646-1327) is shown in FIG. 65 (SEQ ID NO:177). Clone UNQ387 (DNA49646-1327) contains a single open reading frame with an apparent translational initiation site at nucleotide positions 223–225 and ending at the stop codon at nucleotide positions 1285–1287 (FIG. 65). The predicted polypeptide precursor is 354 amino acids long (FIG. 66). The full-length PRO719 protein shown in FIG. 66 has an estimated molecular weight of about 39,362 daltons and a pI of about 8.35. Analysis of the full length PRO719 sequence evidences the presence of a signal peptide from about amino acid 1 to about amino acid 16 as shown in FIG. 66 (SEQ ID NO:178), a lipase-associated serine-containing active site at about amino acid 163 to about amino acid 172, and two potential N-glycosylation sites from about amino acid 80 to about amino acid 83 and about amino acid 136 to about amino acid 139. Clone UNQ387 (DNA49646-1327) has been deposited with ATCC on Mar. 26, 1998 and is assigned ATCC deposit no. 209705.

Analysis of the amino acid sequence of the full-length PRO719 polypeptide suggests that it possesses significant sequence similarity to the lipoprotein lipase H protein, thereby indicating that PRO719 may be a novel lipoprotein lipase homolog. More specifically, an analysis of the Dayhoff database (version 35.45 SwissProt 35) evidenced significant homology between the PRO719 amino acid sequence and the following Dayhoff sequences, LIPL_HUMAN, LIPH_HUMAN, D83548_1, A24059_1, P_R30740, D88666_1, A43357, A46696, B43357 and A49488.

Example 30

Isolation of cDNA Clones Encoding Human PRO724

A consensus sequence was obtained relative to a variety of EST sequences as described in Example 1 above, wherein the consensus sequence obtained is herein designated DNA35603. Based on the DNA35603 consensus sequence, oligonucleotides were synthesized: 1) to identify by PCR a cDNA library that contained the sequence of interest, and 2) for use as probes to isolate a clone of the full-length coding sequence for PRO724.

Pairs of PCR primers (forward and reverse) were synthesized:

forward PCR primer 1
5'-GGCTGTCACTGTGGAGACAC-3'  (SEQ ID NO:184)

```
-continued
forward PCR primer 2
5'-GCAAGGTCATTACAGCTG-3'          (SEQ ID NO:185)

reverse PCR primer 1
5'-AGAACATAGGAGCAGTCCCACTC-3'     (SEQ ID NO:186)

reverse PCR primer 2
5'-TGCCTGCTGCTGCACAATCTCAG-3'     (SEQ ID NO:187)
```

Additionally, a synthetic oligonucleotide hybridization probe was constructed from the consensus DNA35603 sequence which had the following nucleotide sequence

```
hybridization probe                (SEQ ID NO:188)
5'-GGCTATTGCTTGCCTTGGGACAGACCCTGTGGCTTAGGCTCTGGC-3'
```

In order to screen several libraries for a source of a full-length clone, DNA from the libraries was screened by PCR amplification with the PCR primer pairs identified above. A positive library was then used to isolate clones encoding the PRO724 gene using the probe oligonucleotide and one of the PCR primers. RNA for construction of the cDNA libraries was isolated from human fetal lung tissue (LIB26).

DNA sequencing of the clones isolated as described above gave the full-length DNA sequence for PRO724 [herein designated as UNQ389 (DNA49631-1328)] (SEQ ID NO:182) and the derived protein sequence for PRO724.

The entire nucleotide sequence of UNQ389 (DNA49631-1328) is shown in FIG. 67 (SEQ ID NO:182). Clone UNQ389 (DNA49631-1328) contains a single open reading frame with an apparent translational initiation site at nucleotide positions 546–548 and ending at the stop codon at nucleotide positions 2685–2687 (FIG. 67). The predicted polypeptide precursor is 713 amino acids long (FIG. 68). The full-length PRO724 protein shown in FIG. 68 has an estimated molecular weight of about 76,193 daltons and a pI of about 5.42. Analysis of the full-length PRO724 amino acid sequence shown in FIG. 68 (SEQ ID NO:183) evidences the presence of the following: a signal peptide from about amino acid 1 to about amino acid 16, a transmembrane domain from about amino acid 442 to about amino acid 462 and LDL receptor class A domain regions from about amino acid 152 to about amino acid 171, about amino acid 331 to about amino acid 350, about amino acid 374 to about amino acid 393 and about amino acid 411 to about amino acid 430. Clone UNQ389 (DNA49631-1328) has been deposited with ATCC on Apr. 28, 1998 and is assigned ATCC deposit no. 209806

Analysis of the amino acid sequence of the full-length PRO724 polypeptide suggests that it possesses significant sequence similarity to the human LDL receptor protein, thereby indicating that PRO724 may be a novel LDL receptor homolog. More specifically, an analysis of the Dayhoff database (version 35.45 SwissProt 35) evidenced significant homology between the PRO724 amino acid sequence and the following Dayhoff sequences, P_R48547, MMAM2R_1, LRP2_RAT, P_R60517, P_R47861, P_R05533, A44513_1, A30363, P_R74692 and LMLIPOHO_1.

Example 31

Isolation of cDNA Clones Encoding Human PRO772

One cDNA sequence was isolated in the amylase screen described in Example 2, wherein that cDNA sequence is herein designated DNA43509 (see FIG. 71). Based on the DNA43509 sequence, oligonucleotide probes were generated and used to screen a human fetal lung library (LIB25) prepared as described in paragraph 1 of Example 2 above. The cloning vector was pRK5B (pRK5B is a precursor of pRK5D that does not contain the SfiI site; see, Holmes et al., *Science,* 253:1278–1280 (1991)), and the cDNA size cut was less than 2800 bp.

A pair of PCR primers (forward and reverse) were synthesized based on the DNA43509 sequence:

```
forward PCR primer
5'-CGTTTTGCAGAACCTACTCAGGCAG-3'   (SEQ ID NO:192)

reverse PCR primer
5'-CCTCCACCAACTGTCAATGTTGTGG-3'   (SEQ ID NO:193)
```

Additionally, a synthetic oligonucleotide hybridization probe was constructed from the consensus DNA43509 sequence which had the following nucleotide sequence

```
hybridization probe                (SEQ ID NO:194)
5'-AAAGTGCTGCTGCTGGGTCTGCAGACGCGATGGATAACGT-3'
```

Using the above described primers and library, a full length clone was identified that contained a single open reading frame with an apparent translational initiation site at nucleotide positions 131–133 and ending at the stop codon found at nucleotide positions 587–589 (FIG. 69; SEQ ID NO:189). The predicted polypeptide precursor is 152 amino acids long, has a calculated molecular weight of approximately 17,170 daltons and an estimated pI of approximately 9.62. Analysis of the full-length PRO772 sequence shown in FIG. 70 (SEQ ID NO:190) evidences the presence of the following: a potential type II transmembrane domain from about amino acid 26 to about amino acid 42, other potential transmembrane domains from about amino acid 44 to about amino acid 65, from about amino acid 81 to about amino acid 101 and from about amino acid 109 to about amino acid 129, leucine zipper pattern sequences from about amino acid 78 to about amino acid 99 and from about amino acid 85 to about amino acid 106. Clone UNQ410 (DNA49645-1347) has been deposited with ATCC on Apr. 28, 1998 and is assigned ATCC deposit no. 209809.

Analysis of the amino acid sequence of the full-length PRO772 polypeptide suggests that it possesses significant sequence similarity to the human A4 protein, thereby indicating that PRO772 may be a novel A4 protein homolog. More specifically, an analysis of the Dayhoff database (version 35.45 SwissProt 35) evidenced significant homology between the PRO772 amino acid sequence and the following Dayhoff sequences, HSU93305_1, A4P_HUMAN, CELB0454_2, VPU_JSRV, CELC12D12_2, OCCM_AGRT1, LBPHIG1E_50, YIGK_ECOLI, S76245 and P_R50807.

Example 32

Isolation of cDNA Clones Encoding Human PRO852

A consensus sequence was obtained relative to a variety of EST sequences as described in Example 1 above, wherein the consensus sequence obtained is herein designated DNA34364. Based on the DNA34364 consensus sequence, oligonucleotides were synthesized: 1) to identify by PCR a cDNA library that contained the sequence of interest, and 2) for use as probes to isolate a clone of the full-length coding sequence for PRO852.

PCR primers (forward and reverse) were synthesized:

```
forward PCR primer 1
5'-CGCAGAAGCTACAGATTCTCG-3'      (SEQ ID NO:197)

forward PCR primer 2
5'-GGAAATTGGAGGCCAAAGC-3'        (SEQ ID NO:198)

forward PCR primer 3
5'-GGATGTAGCCAGCAACTGTG-3'       (SEQ ID NO:199)

forward PCR primer 4
5'-GCCTTGGCTCGTTCTCTTC-3'        (SEQ ID NO:200)

forward PCR primer 5
5'-GGTCCTGTGCCTGGATGG-3'         (SEQ ID NO:201)

reverse PCR primer 1
5'-GACAAGACTACCTCCGTTGGTC-3'     (SEQ ID NO:202)

reverse PCR primer 2
5'-TGATGCACAGTTCAGCACCTGTTG-3'   (SEQ ID NO:203)
```

Additionally, a synthetic oligonucleotide hybridization probe was constructed from the consensus DNA34364 sequence which had the following nucleotide sequence

```
hybridization probe                     (SEQ ID NO:204)
5'-CGCTCCAAGGGCTTTGACGTCACAGTGAAGTACACACAAGGAAGCTG-3'
```

In order to screen several libraries for a source of a full-length clone, DNA from the libraries was screened by PCR amplification with the PCR primer pair identified above. A positive library was then used to isolate clones encoding the PRO852 gene using the probe oligonucleotide and one of the PCR primers. RNA for construction of the cDNA libraries was isolated from human fetal kidney tissue (LIB228).

DNA sequencing of the clones isolated as described above gave the full-length DNA sequence for PRO852 [herein designated as UNQ418 (DNA45493-1349)] (SEQ ID NO:195) and the derived protein sequence for PRO852.

The entire nucleotide sequence of UNQ418 (DNA45493-1349) is shown in FIG. 72 (SEQ ID NO:195). Clone UNQ418 (DNA45493-1349) contains a single open reading frame with an apparent translational initiation site at nucleotide positions 94–96 and ending at the stop codon at nucleotide positions 16748–1650 (FIG. 72). The predicted polypeptide precursor is 518 amino acids long (FIG. 73). The full-length PRO852 protein shown in FIG. 73 has an estimated molecular weight of about 56,180 daltons and a pI of about 5.08. Analysis of the full-length PRO852 sequence shown in FIG. 73 (SEQ ID NO:196) evidences the presence of the following: a signal peptide from about amino acid 1 to about amino acid 20, a transmembrane domain from about amino acid 466 to about amino acid 494, potential N-glycosylation sites from about amino acid 170 to about amino acid 173 and about amino acid 366 to about amino acid 369, leucine zipper sequence pattern blocks from about amino acid 10 to about amino acid 31 and from about amino acid 197 to about amino acid 218 and blocks of amino acids having sequence homology to eukaryotic and viral aspartyl proteases from about amino acid 109 to about amino acid 118, from about amino acid 252 to about amino acid 261 and from about amino acid 298 to about amino acid 310. Clone UNQ418 (DNA45493-1349) has been deposited with ATCC on Apr. 28, 1998 and is assigned ATCC deposit no. 209805.

Analysis of the amino acid sequence of the full-length PRO852 polypeptide suggests that it possesses significant sequence similarity to various protease proteins, thereby indicating that PRO852 may be a novel protease protein or homolog thereof. More specifically, an analysis of the Dayhoff database (version 35.45 SwissProt 35) evidenced significant homology between the PRO852 amino acid sequence and the following Dayhoff sequences, PEPC_HUMAN, S66516, S66517, PEPE_CHICK, CATD_HUMAN, P_R74207, CARP_YEAST, PEP2_RABIT, CATE_HUMAN and RENI_MOUSE.

Example 33

Isolation of cDNA Clones Encoding Human PRO853

A consensus sequence was obtained relative to a variety of EST sequences as described in Example 1 above, wherein the consensus sequence obtained is herein designated DNA43050. Based on the DNA43050 consensus sequence, oligonucleotides were synthesized: 1) to identify by PCR a cDNA library that contained the sequence of interest, and 2) for use as probes to isolate a clone of the full-length coding sequence for PRO853.

Forward and reverse PCR primers were synthesized:

```
forward PCR primer
5'-CTTCATGGCCTTGGACTTGGCCAG-3'   (SEQ ID NO:207)

reverse PCR primer
5'-ACGCCAGTGGCCTCAAGCTGGTTG-3'   (SEQ ID NO:208)
```

Additionally, a synthetic oligonucleotide hybridization probe was constructed from the consensus DNA43050 sequence which had the following nucleotide sequence

```
hybridization probe                     (SEQ ID NO:209)
5'-CTTTCTGAGCTCTGAGCCACGGTTGGACATCCTCATCCACAATGC-3'
```

In order to screen several libraries for a source of a full-length clone, DNA from the libraries was screened by PCR amplification with one of the PCR primer pairs identified above. A positive library was then used to isolate clones encoding the PRO853 gene using the probe oligonucleotide and one of the PCR primers. RNA for construction of the cDNA libraries was isolated from human fetal kidney tissue (LIB228).

DNA sequencing of the clones isolated as described above gave the full-length DNA sequence for PRO853 [herein designated as UNQ419 (DNA48227-1350)] (SEQ ID NO:205) and the derived protein sequence for PRO853.

The entire nucleotide sequence of UNQ419 (DNA48227-1350) is shown in FIG. 74 (SEQ ID NO:205). Clone UNQ419 (DNA48227-1350) contains a single open reading frame with an apparent translational initiation site at nucleotide positions 128–130 and ending at the stop codon at nucleotide positions 1259–1261 (FIG. 74). The predicted polypeptide precursor is 377 amino acids long (FIG. 75). The full-length PRO853 protein shown in FIG. 75 has an estimated molecular weight of about 40,849 daltons and a pI of about 7.98. Important regions of the amino acid sequence of PRO853 include the signal peptide, corresponding to amino acids from about 1 to about 16 of SEQ ID NO:206, the glycosaminoglycan attachment site, corresponding to amino acids from about 46 to about 49 of SEQ ID NO:206, and two sequences typical of the short-chain alcohol dehydrogenase family, corresponding to amino acids from about 37 to about 49 and about 114 to about 124 of SEQ ID NO:206, respectively. Clone UNQ419 (DNA48227-1350) has been deposited with ATCC and is assigned ATCC deposit no. 209812.

Example 34

Isolation of cDNA Clones Encoding Human PRO860

A consensus sequence was obtained relative to a variety of EST sequences as described in Example 1 above, wherein the consensus sequence obtained is herein designated DNA38137. Based on the DNA38137 consensu sequence, oligonucleotides were synthesized: 1) to identify by PCR a cDNA library that contained the sequence of interest, and 2) for use as probes to isolate a clone of the full-length coding sequence for PRO860.

Forward and reverse PCR primers were synthesized:

```
forward PCR primer
5'-GAAGGGACCTACATGTGTGTGGCC-3'    (SEQ ID NO:212)

reverse PCR primer
5'-ACTGACCTTCCAGCTGAGCCACAC-3'    (SEQ ID NO:213)
```

Additionally, a synthetic oligonucleotide hybridization probe was constructed from the consensus DNA40654 sequence which had the following nucleotide sequence

```
hybridization probe                         (SEQ ID NO:214)
5'-AGGACTACACGGAGCCTGTGGAGCTTCTGGCTGTGCGAATTCAGCTG
GAA-3'
```

In order to screen several libraries for a source of a full-length clone, DNA from the libraries was screened by PCR amplification with one of the PCR primer pairs identified above. A positive library was then used to isolate clones encoding the PRO860 gene using the probe oligonucleotide and one of the PCR primers. RNA for construction of the cDNA libraries was isolated from human fetal lung tissue (LIB26).

DNA sequencing of the clones isolated as described above gave the full-length DNA sequence for PRO860 [herein designated as UNQ421 (DNA41404-1352)] (SEQ ID NO:210) and the derived protein sequence for PRO860.

The entire nucleotide sequence of UNQ421 (DNA41404-1352) is shown in FIG. 76 (SEQ ID NO:210). Clone UNQ421 (DNA41404-1352) contains a single open reading frame with an apparent translational initiation site at nucleotide positions 58–60 and ending at the stop codon at nucleotide positions 3013–3015 (FIG. 76). The predicted polypeptide precursor is 985 amino acids long (FIG. 77). The full-length PRO860 protein shown in FIG. 77 has an estimated molecular weight of about 105,336 daltons and a pI of about 6.55. Important regions of the amino acid sequence of PRO860 include the transmembrane region corresponding to about amino acids 448–467, the extracellular domain, corresponding to amino acids about 1–447, several N-glycosylation sites, numerous N-myristoylation sites and a sequence typical of phosphotyrosine interaction domain proteins. Clone UNQ421 (DNA41404-1352) has been deposited with ATCC and is assigned ATCC deposit no. 209844.

Example 35

Isolation of cDNA Clones Encoding Human PRO846

A consensus sequence was obtained relative to a variety of EST sequences as described in Example 1 above, wherein the consensus sequence obtained is herein designated DNA39949. Based on the DNA39949 consensus sequence, oligonucleotides were synthesized: 1) to identify by PCR a cDNA library that contained the sequence of interest, and 2) for use as probes to isolate a clone of the full-length coding sequence for PRO846.

Forward and reverse PCR primers were synthesized:

```
forward PCR primer
5'-CCCTGCAGTGCACCTACAGGGAAG-3'    (SEQ ID NO:217)

reverse PCR primer
5'-CTGTCTTCCCCTGCTTGGCTGTGG-3'    (SEQ ID NO:218)
```

Additionally, a synthetic oligonucleotide hybridization probe was constructed from the consensus DNA39949 sequence which had the following nucleotide sequence

```
hybridization probe                         (SEQ ID NO:219)
5'-GGTGCAGGAAGGGTGGGATCCTCTTCTCTCGCTGCTCTGGCCACATC-
3'
```

In order to screen several libraries for a source of a full-length clone, DNA from the libraries was screened by PCR amplification with one of the PCR primer pairs identified above. A positive library was then used to isolate clones encoding the PRO846 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO846 [herein designated as UNQ422 (DNA44196-1353)] (SEQ ID NO:215) and the derived protein sequence for PRO846.

The entire nucleotide sequence of UNQ422 (DNA44196-1353) is shown in FIG. 78 (SEQ ID NO:215). Clone UNQ422 (DNA4419-1353) contains a single open reading frame with an apparent translational initiation site at nucleotide positions 25–27 and ending at the stop codon at nucleotide positions 1021–1023 (FIG. 78). The predicted polypeptide precursor is 332 amino acids long (FIG. 79). The full-length PRO846 protein shown in FIG. 79 has an estimated molecular weight of about 36,143 daltons and a pI of about 5.89. Important regions of the amino acid sequence of PRO846 include the signal peptide, the transmembrane domain, an N-glycosylation site, a sequence typical of fibrinogen beta and gamma chains C-terminal domain, and a sequence typical of Ig like V-type domain as shown in FIG. 79. Clone UNQ422 (DNA44196-1353) has been deposited with ATCC and is assigned ATCC deposit no. 209847.

Example 36

Isolation of cDNA Clones Encoding Human PRO862

A consensus sequence was obtained relative to a variety of EST sequences as described in Example 1 above, wherein the consensus sequence obtained is herein designated DNA47370. Based on the DNA47370 consensus sequence, oligonucleotides were synthesized: 1) to identify by PCR a cDNA library that contained the sequence of interest, and 2) for use as probes to isolate a clone of the full-length coding sequence for PRO862.

Forward and reverse PCR primers were synthesized:

```
forward PCR primer
5'GGGATCATGTTGTTGGCCCTGGTC-3'     (SEQ ID NO:222)

reverse PCR primer
5'-GCAAGGCAGACCCAGTCAGCCAG-3'    (SEQ ID NO:223)
```

Additionally, a synthetic oligonucleotide hybridization probe was constructed from the consensus DNA47370 sequence which had the following nucleotide sequence

```
hybridization probe                (SEQ ID NO:225)
5'-CTGCCTGCTACCCTCCAAGTGAGGCCAAGCTCTACGGTCGTTGTG-3'
```

In order to screen several libraries for a source of a full-length clone, DNA from the libraries was screened by PCR amplification with one of the PCR primer pairs identified above. A positive library was then used to isolate clones encoding the PRO862 gene using the probe oligonucleotide and one of the PCR primers. RNA for construction of the cDNA libraries was isolated from human pancreas tissue (LIB55).

DNA sequencing of the clones isolated as described above gave the full-length DNA sequence for PRO862 [herein designated as UNQ424 (DNA52187-1354)] (SEQ ID NO:220) and the derived protein sequence for PRO862.

The entire nucleotide sequence of UNQ424 (DNA52187-1354) is shown in FIG. 80 (SEQ ID NO:220). Clone UNQ424 (DNA52187-1354) contains a single open reading frame with an apparent translational initiation site at nucleotide positions 410–412 and ending at the stop codon at nucleotide positions 848–850 (FIG. 80). The predicted polypeptide precursor is 146 amino acids long (FIG. 81). The full-length PRO862 protein shown in FIG. 81 has an estimated molecular weight of about 16,430 daltons and a pI of about 5.05. Important regions of the amino acid sequence of PRO862 include the signal peptide, an N-myristoylation site, and sequences having similarity to region to Alpha-lactalbumin/lysozyme C proteins as shown in FIG. 81. Clone UNQ424 (DNA52187-1354) has been deposited with the ATCC and is assigned ATCC deposit no. 209845.

Example 37

Isolation of cDNA Clones Encoding Human PRO864

A consensus sequence was obtained relative to a variety of EST sequences as described in Example 1 above, wherein the consensus sequence obtained is herein designated DNA40666. Based on the DNA40666 consensus sequence, oligonucleotides were synthesized: 1) to identify by PCR a cDNA library that contained the sequence of interest, and 2) for use as probes to isolate a clone of the full-length coding sequence for PRO864.

Forward and reverse PCR primers were synthesized:

```
forward PCR primer
5'-GCTGCAGCTGCAAATTCCACTGG-3'     (SEQ ID NO:227)

reverse PCR primer
5'-TGGTGGGAGACTGTTTAAATTATCGGCC-3' (SEQ ID NO:228)
```

Additionally, a synthetic oligonucleotide hybridization probe was constructed from the consensus DNA40666 sequence which had the following nucleotide sequence

```
hybridization probe                (SEQ ID NO:229)
5'-TGCTTCGTCAAGTGCCGGCAGTGCCAGCGGCTCGTGGAGTT-3'
```

In order to screen several libraries for a source of a full-length clone, DNA from the libraries was screened by PCR amplification with one of the PCR primer pairs identified above. A positive library was then used to isolate clones encoding the PRO864 gene using the probe oligonucleotide and one of the PCR primers. RNA for construction of the cDNA libraries was isolated from human fetal brain tissue (LIB153).

DNA sequencing of the clones isolated as described above gave the full-length DNA sequence for PRO864 [herein designated as UNQ426 (DNA48328-1355)] (SEQ ID NO:225) and the derived protein sequence for PRO864.

The entire nucleotide sequence of UNQ426 (DNA48328-1355) is shown in FIG. 82 (SEQ ID NO:225). Clone UNQ426 (DNA48328-1355) contains a single open reading frame with an apparent translational initiation site at nucleotide positions 37–39 and ending at the stop codon at nucleotide positions 1090–1092 (FIG. 82). The predicted polypeptide precursor is 351 amino acids long (FIG. 83). The full-length PRO864 protein shown in FIG. 83 has an estimated molecular weight of about 39,052 and a pI of about 8.97. Important regions of the amino acid sequence of PRO864 include the signal peptide, two N-glycosylation sites, a Wnt-1 family signature sequence, and sequence regions homologous to Wnt-1 family proteins as shown in FIG. 83. Clone UNQ426 (DNA48328-1355) has been deposited with ATCC and is assigned ATCC deposit no. 209843.

Example 38

Isolation of cDNA Clones Encoding Human PRO792

A consensus sequence was obtained relative to a variety of EST sequences as described in Example 1 above, wherein the consensus sequence obtained is herein designated DNA38106. Based on the DNA38106 consensus sequence, oligonucleotides were synthesized: 1) to identify by PCR a cDNA library that contained the sequence of interest, and 2) for use as probes to isolate a clone of the full-length coding sequence for PRO792.

A pair of PCR primers (forward and reverse) were synthesized:

```
forward PCR primer
5'-GCGAGAACTGTGTCATGATGCTGC-3'   (SEQ ID NO:232)
```

-continued

```
reverse PCR primer
5'-GTTTCTGAGACTCAGCAGCGGTGG-3'   (SEQ ID NO:233)
```

Additionally, a synthetic oligonucleotide hybridization probe was constructed from the consensus DNA38106 sequence which had the following nucleotide sequence

```
hybridization probe                     (SEQ ID NO:234)
5'-CACCGTGTGACAGCGAGAAGGACGGCTGGATCTGTGAGAAAAGGCACA
AC-3'
```

In order to screen several libraries for a source of a full-length clone, DNA from the libraries was screened by PCR amplification with the PCR primer pair identified above. A positive library was then used to isolate clones encoding the PRO792 gene using the probe oligonucleotide and one of the PCR primers. RNA for construction of the cDNA libraries was isolated from human bone marrow tissue (LIB255).

DNA sequencing of the clones isolated as described above gave the full-length DNA sequence for PRO792 [herein designated as UNQ431 (DNA56352-1358)] (SEQ ID NO:230) and the derived protein sequence for PRO792.

The entire nucleotide sequence of UNQ431 (DNA56352-1358) is shown in FIG. 84 (SEQ ID NO:230). Clone UNQ431 (DNA56352-1358) contains a single open reading frame with an apparent translational initiation site at nucleotide positions 67–69 and ending at the stop codon at nucleotide positions 946–948 (FIG. 84). The predicted polypeptide precursor is 293 amino acids long (FIG. 85). The full-length PRO792 protein shown in FIG. 85 has an estimated molecular weight of about 32,562 daltons and a pI of about 6.53. Analysis of the full-length PRO792 sequence shown in FIG. 85 (SEQ ID NO:231) evidences the presence of the following: a type II transmembrane domain from about amino acid 31 to about amino acid 54, potential N-glycosylation sites from about amino acid 73 to about amino acid 76 and from about amino acid 159 to about amino acid 162, a leucine zipper amino acid sequence pattern from about amino acid 102 to about amino acid 123, potential N-myristolation sites from about amino acid 18 to about amino acid 23, from about amino acid 133 to about amino acid 138 and from about amino acid 242 to about amino acid 247 and a C-type lectin domain signature block from about amino acid 264 to about amino acid 287. Clone UNQ431 (DNA56352-1358) has been deposited with ATCC on May 6, 1998 and is assigned ATCC deposit no. 209846.

Analysis of the amino acid sequence of the full-length PRO792 polypeptide suggests that it possesses significant sequence similarity to the CD23 protein, thereby indicating that PRO792 may be a novel CD23 homolog. More specifically, an analysis of the Dayhoff database (version 35.45 SwissProt 35) evidenced significant homology between the PRO792 amino acid sequence and the following Dayhoff sequences, S34198, A07100__1, A05303__1, P_R41689, P_P82839, A10871__1, P_R12796, P_R47199, A46274 and P__32188.

Example 39

Isolation of cDNA Clones Encoding Human PRO866

A consensus sequence was obtained relative to a variety of EST sequences as described in Example 1 above, wherein the consensus sequence obtained is herein designated DNA44708. Based on the DNA44708 consensus sequence, oligonucleotides were synthesized: 1) to identify by PCR a cDNA library that contained the sequence of interest, and 2) for use as probes to isolate a clone of the full-length coding sequence for PRO866.

PCR primers (forward and reverse) were synthesized:

```
forward PCR primer 1
5'-CAGCACTGCCAGGGGAAGAGGG-3'      (SEQ ID NO:237)

forward PCR primer 2
5'-CAGGACTCGCTACGTCCG-3'          (SEQ ID NO:238)

forward PCR primer 3
5'-CAGCCCCTTCTCCTCCTTTCTCCC-3'    (SEQ ID NO:239)

reverse PCR primer 1
5'-GCAGTTATCAGGGACGCACTCAGCC-3'   (SEQ ID NO:240)

reverse PCR primer 2
5'-CCAGCGAGAGGCAGATAG-3'          (SEQ ID NO:241)

reverse PCR primer 3
5'-CGGTCACCGTGTCCTGCGGGATG-3'     (SEQ ID NO:242)
```

Additionally, a synthetic oligonucleotide hybridization probe was constructed from the consensus DNA44708 sequence which had the following nucleotide sequence

```
hybridization probe                     (SEQ ID NO:243)
5'-CAGCCCCTTCTCCTCCTTTCTCCCACGTCCTATCTGCCTCTC-3'
```

In order to screen several libraries for a source of a full-length clone, DNA from the libraries was screened by PCR amplification with one of the PCR primer pairs identified above. A positive library was then used to isolate clones encoding the PRO866 gene using the probe oligonucleotide and one of the PCR primers. RNA for construction of the cDNA libraries was isolated from human fetal kidney tissue (LIB228).

DNA sequencing of the clones isolated as described above gave the full-length DNA sequence for PRO866 [herein designated as UNQ435 (DNA53971-1359)] (SEQ ID NO:235) and the derived protein sequence for PRO866.

The entire nucleotide sequence of UNQ435 (DNA53971-1359) is shown in FIG. 86 (SEQ ID NO:235). Clone UNQ435 (DNA53971-1359) contains a single open reading frame with an apparent translational initiation site at nucleotide positions 275–277 and ending at the stop codon at nucleotide positions 1268–1270 (FIG. 86). The predicted polypeptide precursor is 331 amino acids long (FIG. 87). The full-length PRO866 protein shown in FIG. 87 has an estimated molecular weight of about 35,844 daltons and a pI of about 5.45. Analysis of the full-length PRO866 sequence shown in FIG. 87 (SEQ ID NO:236) evidences the presence of the following: a signal peptide from about amino acid 1 to about amino acid 26. Clone UNQ435 (DNA53971-1359) has been deposited with ATCC on Apr. 7, 1998 and is assigned ATCC deposit no. 209750.

Analysis of the amino acid sequence of the full-length PRO866 polypeptide suggests that it possesses significant sequence similarity to the mindin/spondin family of proteins, thereby indicating that PRO866 may be a novel mindin homolog. More specifically, an analysis of the Dayhoff database (version 35.45 SwissProt 35) evidenced significant homology between the PRO866 amino acid sequence and the following Dayhoff sequences, AB006085_1, AB006084_1, AB006086_1, AF017267_1, CWU42213_1, AC004160_1, CPMICRP_1, S49108, A48569 and I46687.

Example 40

Isolation of cDNA Clones Encoding Human PRO871

A consensus sequence was obtained relative to a variety of EST sequences as described in Example 1 above, wherein the consensus sequence obtained is herein designated DNA40324. Based on the DNA40324 consensus sequence, oligonucleotides were synthesized: 1) to identify by PCR a cDNA library that contained the sequence of interest, and 2) for use as probes to isolate a clone of the full-length coding sequence for PRO871.

PCR primers (forward and reverse) were synthesized:

```
forward PCR primer 1   5'-TGCGGAGATCCTACTGGCACAGGG-3'      (SEQ ID NO:246)

forward PCR primer 2   5'-CGAGTTAGTCAGAGCATG-3'            (SEQ ID NO:247)

forward PCR primer 3   5'-CAGATGGTGCTGTTGCCG-3'            (SEQ ID NO:248)

reverse PCR primer 1   5'-CAACTGGAACAGGAACTGAGATGTGGATC-3' (SEQ ID NO:249)

reverse PCR primer 2   5'-CTGGTTCAGCAGTGCAAGGGTCTG-3'      (SEQ ID NO:250)

reverse PCR primer 3   5'-CCTCTCCGATTAAAACGC-3'            (SEQ ID NO:251)
```

Additionally, a synthetic oligonucleotide hybridization probe was constructed from the consensus DNA40324 sequence which had the following nucleotide sequence

```
hybridization probe                                        (SEQ ID NO:252)
5'-GAGAGGACTGGTTGCCATGGCAAATGCTGGTTCTCATGATAATGG-3'
```

In order to screen several libraries for a source of a full-length clone, DNA from the libraries was screened by PCR amplification with one of the PCR primer pairs identified above. A positive library was then used to isolate clones encoding the PRO871 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO871 [herein designated as UNQ438 (DNA50919-1361)] (SEQ ID NO:244) and the derived protein sequence for PRO871.

The entire nucleotide sequence of UNQ438 (DNA50919-1361) is shown in FIG. 88 (SEQ ID NO:244). Clone UNQ438 (DNA50919-1361) contains a single open reading frame with an apparent translational initiation site at nucleotide positions 191–193 and ending at the stop codon at nucleotide positions 1607–1609 (FIG. 88). The predicted polypeptide precursor is 472 amino acids long (FIG. 89). The full-length PRO871 protein shown in FIG. 89 has an estimated molecular weight of about 53,847 daltons and a pI of about 5.75. Analysis of the full-length PRO871 sequence shown in FIG. 89 (SEQ ID NO:245) evidences the presence of the following: a signal peptide from about amino acid 1 to about amino acid 21, potential N-glycosylation sites from about amino acid 109 to about amino acid 112 and from about amino acid 201 to about amino acid 204, a cyclophilin-type peptidy-prolyl cis-trans isomerase signature sequence from about amino acid 49 to about amino acid 66 and regions that are homologous to cyclophilin-type peptidy-prolyl cis-trans isomerases from about amino acid 96 to about amino acid 140, from about amino acid 49 to about amino acid 89 and from about amino acid 22 to about amino acid 51. Clone UNQ438 (DNA50919-1361) has been deposited with ATCC on May 6, 1998 and is assigned ATCC deposit no. 209848.

Analysis of the amino acid sequence of the full-length PRO871 polypeptide suggests that it possesses significant sequence similarity to the cyclophilin family of proteins, thereby indicating that PRO871 may be a novel cyclophilin protein family member. More specifically, an analysis of the Dayhoff database (version 35.45 SwissProt 35) evidenced significant homology between the PRO871 amino acid sequence and the following Dayhoff sequences, SPBC16H5_5, S64705, YAL5_SCHPO, CYP4_CAEEL, CELC34D4_7, CYPA_CAEEL, HUMORF006_1, CYPI_MYCTU, AF043642_1 and HSSRCYP_1.

Example 41

Isolation of cDNA Clones Encoding Human PRO873

A consensus sequence was obtained relative to a variety of EST sequences as described in Example 1 above, wherein the consensus sequence obtained is herein designated DNA39621. Based on the DNA39621 consensus sequence, oligonucleotides were synthesized: 1) to identify by PCR a cDNA library that contained the sequence of interest, and 2) for use as probes to isolate a clone of the full-length coding sequence for PRO873.

A pair of PCR primers (forward and reverse) were synthesized:

```
forward PCR primer
5'-AGGTGCCTGCAGGAGTCCTGGGG-3'      (SEQ ID NO:255)

reverse PCR primer
5'-CCACCTCAGGAAGCCGAAGATGCC-3'     (SEQ ID NO:256)
```

Additionally, a synthetic oligonucleotide hybridization probe was constructed from the consensus DNA39621 sequence which had the following nucleotide sequence:

```
hybridization probe                                        (SEQ ID NO:257)
5'-GAACGGTACAAGTGGCTGCGCTTCAGCGAGGACTGTCTGTACCTG-3'
```

In order to screen several libraries for a source of a full-length clone, DNA from the libraries was screened by PCR amplification with the PCR primer pair identified above. A positive library was then used to isolate clones encoding the PRO873 gene using the probe oligonucleotide and one of the PCR primers. RNA for construction of the cDNA libraries was isolated from human fetal liver tissue (LIB3229).

DNA sequencing of the clones isolated as described above gave the full-length DNA sequence for PRO873 [herein designated as UNQ440 (DNA44179-1362)] (SEQ ID NO:253) and the derived protein sequence for PRO873.

The entire nucleotide sequence of UNQ440 (DNA44179-1362) is shown in FIG. 90 (SEQ ID NO:253). Clone UNQ440 (DNA44179-1362) contains a single open reading frame with an apparent translational initiation site at nucleotide positions 139–141 and ending at the stop codon at nucleotide positions 1774–1776 (FIG. 90). The predicted polypeptide precursor is 545 amino acids long (FIG. 91). The full-length PRO873 protein shown in FIG. 91 has an estimated molecular weight of about 58,934 daltons and a pI of about 9.45. Analysis of the full-length PRO873 sequence shown in FIG. 91 (SEQ ID NO:254) evidences the presence of the following features: a signal peptide from about amino acid 1 to about amino acid 29; a carboxylesterase type-B serine active site at about amino acid 312 to about amino acid 327; a carboxylesterase type-B signature 2 motif at about amino acid 218 to about amino acid 228; and three potential N-glycosylation sites at about amino acid 318 to about amino acid 321, about amino acid 380 to about amino acid 383, and about amino acid 465 to about amino acid 468. Clone UNQ440 (DNA44179-1362) has been deposited with ATCC on May 6, 1998 and is assigned ATCC deposit no. 209851.

Analysis of the amino acid sequence of the full-length PRO873 polypeptide suggests that it possesses significant sequence similarity to a human liver carboxylesterase, thereby indicating that PRO873 may be a novel carboxylesterase. More specifically, an analysis of the Dayhoff database (version 35.45 SwissProt 35) evidenced significant homology between the PRO873 amino acid sequence and the following Dayhoff sequences: ES10_RAT, GEN12405, AB010633_1, EST4_RAT, A48809, SASB_ANAPL, RNU41662_1, RNU22952_1, BAL_RAT, GEN13522.

Example 42

Isolation of cDNA Clones Encoding Human PRO940

A consensus sequence was obtained relative to a variety of EST sequences as described in Example 1 above, wherein the consensus sequence obtained is herein designated DNA47442. Based on the DNA47442 consensus sequence, oligonucleotides were synthesized: 1) to identify by PCR a cDNA library that contained the sequence of interest, and 2) for use as probes to isolate a clone of the full-length coding sequence for PRO940.

A pair of PCR primers (forward and reverse) were synthesized:

```
forward PCR primer
5'-CAAAGCCTGCGCCTGGTCTGTG-3'       (SEQ ID NO:260)

reverse PCR primer
5'-TTCTGGAGCCCAGAGGGTGCTGAG-3'     (SEQ ID NO:262)
```

Additionally, a synthetic oligonucleotide hybridization probe was constructed from the consensus DNA47442 sequence which had the following nucleotide sequence

```
hybridization probe                 (SEQ ID NO:263)
5'-GGAGCTGCCACCCATTCAAATGGAGCACGAAGGAGAGTTCACCTG-3'
```

In order to screen several libraries for a source of a full-length clone, DNA from the libraries was screened by PCR amplification with the PCR primer pair identified above. A positive library was then used to isolate clones encoding the PRO940 gene using the probe oligonucleotide and one of the PCR primers. RNA for construction of the cDNA libraries was isolated from human fetal liver tissue (LIB229).

DNA sequencing of the clones isolated as described above gave the full-length DNA sequence for PRO940 [herein designated as UNQ477 (DNA54002-1367)] (SEQ ID NO:258) and the derived protein sequence for PRO940.

The entire nucleotide sequence of UNQ477 (DNA54002-1367) is shown in FIG. 92 (SEQ ID NO:258). Clone UNQ477 (DNA54002-1367) contains a single open reading frame with an apparent translational initiation site at nucleotide positions 46–48 and ending at the stop codon at nucleotide positions 1678–1680 (FIG. 92). The predicted polypeptide precursor is 544 amino acids long (FIG. 93). The full-length PRO940 protein shown in FIG. 93 has an estimated molecular weight of about 60,268 daltons and a pI of about 9.53. Analysis of the full-length PRO940 sequence shown in FIG. 93 (SEQ ID NO:259) evidences the presence of the following: a signal peptide from about amino acid 1 to about amino acid 15, potential N-glycosylation sites from about amino acid 100 to about amino acid 103, from about amino acid 297 to about amino acid 300 and from about amino acid 306 to about amino acid 309 and an immunoglobulin and major histocompatibility complex signature sequence block from about amino acid 365 to about amino acid 371. Clone UNQ477 (DNA54002-1367) has been deposited with ATCC on Apr. 7, 1998 and is assigned ATCC deposit no. 209754.

Analysis of the amino acid sequence of the full-length PRO940 polypeptide suggests that it possesses significant sequence similarity to CD33 and the OB binding protein-2. More specifically, an analysis of the Dayhoff database (version 35.45 SwissProt 35) evidenced significant homology between the PRO940 amino acid sequence and the following Dayhoff sequences, CD33_HUMAN, HSU71382_1, HSU71383_1, D86359_1, PGBM_HUMAN, MAGS_MOUSE, D86983_1, C22B_HUMAN, P_W01002 and HVU24116_1.

Example 43

Isolation of cDNA Clones Encoding Human PRO941

A consensus sequence was obtained relative to a variety of EST sequences as described in Example 1 above, wherein the consensus sequence obtained is herein designated DNA35941. An EST sequence proprietary to Genentech was employed in the assembly and is herein designated DNA6415 (FIG. 96; SEQ ID NO:265). Based on the DNA35941 consensus sequence, oligonucleotides were synthesized: 1) to identify by PCR a cDNA library that contained the sequence of interest, and 2) for use as probes to isolate a clone of the full-length coding sequence for PRO941.

A pair of PCR primers (forward and reverse) were synthesized:

```
forward PCR primer
5'-CTTGACTGTCTCTGAATCTGCACCC-3'    (SEQ ID NO:266)

reverse PCR primer
5'-AAGTGGTGGAAGCCTCCAGTGTGG-3'    (SEQ ID NO:267)
```

Additionally, a synthetic oligonucleotide hybridization probe was constructed from the consensus DNA35941 sequence which had the following nucleotide sequence

```
hybridization probe                (SEQ ID NO:268)
5'-CCACTACGGTATTAGAGCAAAAGTTAAAAACCATCATGGTTCCTGGAG
CAGC-3'
```

In order to screen several libraries for a source of a full-length clone, DNA from the libraries was screened by PCR amplification with the PCR primer pair identified above. A positive library was then used to isolate clones encoding the PRO941 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO941 [herein designated as UNQ478 (DNA53906-1368)] (SEQ ID NO:263) and the derived protein sequence for PRO941.

The entire nucleotide sequence of UNQ478 (DNA53906-1368) is shown in FIG. 94 (SEQ ID NO:263). Clone UNQ478 (DNA53906-1368) contains a single open reading frame with an apparent translational initiation site at nucleotide positions 37–39 and ending at the stop codon at nucleotide positions 2353–2355 (FIG. 94). The predicted polypeptide precursor is 772 amino acids long (FIG. 95). The full-length PRO941 protein shown in FIG. 95 has an estimated molecular weight of about 87,002 daltons and a pI of about 4.64. Analysis of the full-length PRO941 sequence shown in FIG. 95 (SEQ ID NO:264) evidences the presence of the following: a signal peptide from about amino acid 1 to about amino acid 21, potential N-glycosylation sites from about amino acid 57 to about amino acid 60, from about amino acid 74 to about amino acid 77, from about amino acid 419 to about amino acid 422, from about amino acid 437 to about amino acid 440, from about amino acid 508 to about amino acid 511, from about amino acid 515 to about amino acid 518, from about amino acid 516 to about amino acid 519 and from about amino acid 534 to about amino acid 537, and cadherin extracellular repeated domain signature sequences from about amino acid 136 to about amino acid 146 and from about amino acid 244 to about amino acid 254. Clone UNQ478 (DNA53906-1368) has been deposited with ATCC on Apr. 7, 1998 and is assigned ATCC deposit no. 209747.

Analysis of the amino acid sequence of the full-length PRO941 polypeptide suggests that it possesses significant sequence similarity to a cadherin protein, thereby indicating that PRO941 may be a novel cadherin protein family member. More specifically, an analysis of the Dayhoff database (version 35.45 SwissProt 35) evidenced significant homology between the PRO941 amino acid sequence and the following Dayhoff sequences, I50180, CADA_CHICK, I50178, GEN12782, CADC_HUMAN, P_W25637, A38992, P_R49731, D38992 and G02678.

Example 44

Isolation of cDNA Clones Encoding Human PRO944

A consensus sequence was obtained relative to a variety of EST sequences as described in Example 1 above, wherein the consensus sequence obtained is herein designated DNA47374. A variety of proprietary Genentech EST sequences were employed in the assembly and are shown in FIGS. 99–107. Based on the DNA47374 consensus sequence, oligonucleotides were synthesized: 1) to identify by PCR a cDNA library that contained the sequence of interest, and 2) for use as probes to isolate a clone of the full-length coding sequence for PRO944.

A pair of PCR primers (forward and reverse) were synthesized:

```
forward PCR primer
5'-CGAGCGAGTCATGGCCAACGC-3'        (SEQ ID NO:280)

reverse PCR primer
5'-GTGTCACACGTAGTCTTTCCCGCTGG-3'   (SEQ ID NO:281)
```

Additionally, a synthetic oligonucleotide hybridization probe was constructed from the consensus DNA47374 sequence which had the following nucleotide sequence

```
hybridization probe                (SEQ ID NO:282)
5'-CTGCAGCTGTTGGGCTTCATTCTCGCCTTCCTGGGATGGATCG-3'
```

In order to screen several libraries for a source of a full-length clone, DNA from the libraries was screened by PCR amplification with the PCR primer pair identified above. A positive library was then used to isolate clones encoding the PRO944 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO944 [herein designated as UNQ481 (DNA52185-1370)] (SEQ ID NO:269) and the derived protein sequence for PRO944.

The entire nucleotide sequence of UNQ481 (DNA52185-1370) is shown in FIG. 97 (SEQ ID NO:269). Clone UNQ481 (DNA52185-1370) contains a single open reading frame with an apparent translational initiation site at nucleotide positions 219–221 and ending at the stop codon at nucleotide positions 852–854 (FIG. 97). The predicted polypeptide precursor is 211 amino acids long (FIG. 98). The full-length PRO944 protein shown in FIG. 98 has an estimated molecular weight of about 22,744 daltons and a pI of about 8.51. Analysis of the full-length PRO944 sequence shown in FIG. 98 (SEQ ID NO:270) evidences the presence of the following: a signal peptide from about amino acid 1 to about amino acid 21, transmembrane domains from about amino acid 82 to about amino acid 102, from about amino acid 118 to about amino acid 142 and from about amino acid 161 to about amino acid 187, a potential N-glycosylation site from about amino acid 72 to about amino acid 75, a sequence block having homology to PMP-22/EMP/MP20 family of proteins from about amino acid 70 to about amino acid 111 and a sequence block having homology to ABC-2 type transport system integral membrane protein from about amino acid 119 to about amino acid 133. Clone UNQ481

(DNA52185-1370) has been deposited with ATCC on May 14, 1998 and is assigned ATCC deposit no. 209861.

Analysis of the amino acid sequence of the full-length PRO944 polypeptide suggests that it possesses significant sequence similarity to the CPE-R protein, thereby indicating that PRO944 may be a novel CPE-R homolog. More specifically, an analysis of the Dayhoff database (version 35.45 SwissProt 35) evidenced significant homology between the PRO944 amino acid sequence and the following Dayhoff sequences, AB000713_1, AB000714_1, AF035814_1, AF000959_1, HSU89916_1, EMP2_HUMAN, JC5732, CELF53B3_6, PM22_MOUSE and CGU49797_1.

Example 45

Isolation of cDNA Clones Encoding Human PRO983

A consensus sequence was obtained relative to a variety of EST sequences as described in Example 1 above, wherein the consensus sequence obtained is herein designated DNA47473. Various proprietary Genentech EST sequences were employed in the assembly, wherein those EST sequences are shown in FIGS. 110–116. Based on the DNA47473 consensus sequence, oligonucleotides were synthesized: 1) to identify by PCR a cDNA library that contained the sequence of interest, and 2) for use as probes to isolate a clone of the full-length coding sequence for PRO983.

A pair of PCR primers (forward and reverse) were synthesized:

```
forward PCR primer
5'-GCACCACCGTAGGTACTTGTGTGAGGC-3'   (SEQ ID NO:292)

reverse PCR primer
5'-AACCACCAGAGCCAAGAGCCGGG-3'       (SEQ ID NO:293)
```

Additionally, a synthetic oligonucleotide hybridization probe was constructed from the consensus DNA47473 sequence which had the following nucleotide sequence

```
hybridization probe                 (SEQ ID NO:294)
5'-
CAGCGGAATCATCGATGCAGGGGCCTCAATTAATGTATCTGTGATGTTAC-
3'
```

In order to screen several libraries for a source of a full-length clone, DNA from the libraries was screened by PCR amplification with the PCR primer pair identified above. A positive library was then used to isolate clones encoding the PRO983 gene using the probe oligonucleotide and one of the PCR primers. RNA for construction of the cDNA libraries was isolated from human bone marrow (LIB256).

DNA sequencing of the clones isolated as described above gave the full-length DNA sequence for PRO983 [herein designated as UNQ484 (DNA53977-137 1)] (SEQ ID NO:283) and the derived protein sequence for PRO983.

The entire nucleotide sequence of UNQ484 (DNA53977-1371) is shown in FIG. 108 (SEQ ID NO:283). Clone UNQ484 (DNA53977-1371) contains a single open reading frame with an apparent translational initiation site at nucleotide positions 234–236 and ending at the stop codon at nucleotide positions 963–965 (FIG. 108). The predicted polypeptide precursor is 243 amino acids long (FIG. 109). The full-length PRO983 protein shown in FIG. 109 has an estimated molecular weight of about 27,228 daltons and a pI of about 7.43. Analysis of the full-length PRO983 sequence shown in FIG. 109 (SEQ ID NO:284) evidences the presence of the following features: a putative transmembrane domain from about amino acid 224 to about amino acid 239; a potential N-glycosylation site from about amino acid 68 to about amino acid 71; and three potential N-myristoylation sites from about amino acid 59 to about amino acid 64, from about amino acid 64 to about amino acid 69, and from about amino acid 235 to about amino acid 240. Clone UNQ484 (DNA53977-1371) has been deposited with ATCC on May 14, 1998 and is assigned ATCC deposit no. 209862.

Analysis of the amino acid sequence of the full-length PRO983 polypeptide suggests that it possesses significant sequence similarity to the vesicle-associated protein, VAP-33, thereby indicating that PRO983 may be a novel vesicle associated membrane protein. More specifically, an analysis of the Dayhoff database (version 35.45 SwissProt 35) evidenced significant homology between the PRO983 amino acid sequence and the following Dayhoff sequences: VP33_APLCA, CELF33D11_12, CELF42G2_2, S50623, YDFC_SCHPO, CELF54H5_2, CELZC196_8, CEF57A10_3, MSP3_GLORO, CEC15H11_1.

Example 46

Isolation of cDNA Clones Encoding Human PRO1057

A consensus sequence was obtained relative to a variety of EST sequences as described in Example 1 above, wherein the consensus sequence obtained is herein designated DNA49808. Based on the DNA49808 consensus sequence, oligonucleotides were synthesized: 1) to identify by PCR a cDNA library that contained the sequence of interest, and 2) for use as probes to isolate a clone of the full-length coding sequence for PRO1057.

PCR primers (forward and reverse) were synthesized:

```
forward PCR primer
5'-GCATCTGCAGGAGAGAGCGAAGGG-3'     (SEQ ID NO:297)

reverse PCR primer
5'-CATCGTTCCCGTGAATCCAGAGGC-3'     (SEQ ID NO:298)
```

Additionally, a synthetic oligonucleotide hybridization probe was constructed from the consensus DNA49808 sequence which had the following nucleotide sequence

```
hybridization probe                        (SEQ ID NO:299)
5'-GAAGGGAGGCCTTCCTTTCAGTGGACCCGGGTCAAGAATACCCAC-3'
```

In order to screen several libraries for a source of a full-length clone, DNA from the libraries was screened by PCR amplification with the PCR primer pair identified above. A positive library was then used to isolate clones encoding the PRO1057 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO1057 [herein designated as UNQ522 (DNA57253-1382)] (SEQ ID NO:295) and the derived protein sequence for PRO1057.

The entire nucleotide sequence of UNQ522 (DNA57253-1382) is shown in FIG. 117 (SEQ ID NO:295). Clone UNQ522 (DNA57253-1382) contains a single open reading frame with an apparent translational initiation site at nucleotide positions 275–277 and ending at the stop codon at nucleotide positions 1514–1516 (FIG. 117). The predicted polypeptide precursor is 413 amino acids long (FIG. 118). The full-length PRO1057 protein shown in FIG. 118 has an estimated molecular weight of about 47,070 daltons and a pI of about 9.92. Analysis of the full-length PRO1057 sequence shown in FIG. 118 (SEQ ID NO:296) evidences the presence of the following: a signal peptide from about amino acid 1 to about amino acid 16, potential N-glycosylation sites from about amino acid 90 to about amino acid 93, from about amino acid 110 to about amino acid 113 and from about amino acid 193 to about amino acid 196, a glycosaminoglycan attachment site from about amino acid 236 to about amino acid 239 and a serine protease histidine-containing active site from about amino acid 165 to about amino acid 170. Clone UNQ522 (DNA57253-1382) has been deposited with ATCC on May 14, 1998 and is assigned ATCC deposit no. 209867.

Analysis of the amino acid sequence of the full-length PRO1057 polypeptide suggests that it possesses significant sequence similarity to various protease proteins, thereby indicating that PRO1057 may be a novel protease. More specifically, an analysis of the Dayhoff database (version 35.45 SwissProt 35) evidenced significant homology between the PRO1057 amino acid sequence and the following Dayhoff sequences, TRYE_DROER, P_R14159, A69660, EBN1_EBV, S65494, GEN12688, A51084_1, P_R99571, A57514 and AF003200_1.

Example 47

Isolation of cDNA Clones Encoding Human PRO1071

A consensus sequence was obtained relative to a variety of EST sequences as described in Example 1 above, wherein the consensus sequence obtained is herein designated DNA53035. Based on the DNA53035 consensus sequence, it was determined that that consensus sequence shared significant sequence identity with Incyte EST clone no. 2872569, a clone that upon review appeared to encode a full length protein. As such, Incyte EST clone no. 2872569 was purchased and its insert was obtained and sequenced so as to confirm the proper sequence. This sequence is herein designated UNQ528 or DNA58847-1383.

DNA sequencing of the clone isolated as described above gave the full-length DNA sequence for PRO1071 [herein designated as UNQ528 (DNA58847-1383)] (SEQ ID NO:300) and the derived protein sequence for PRO1071.

The entire nucleotide sequence of UNQ528 (DNA58847-1383) is shown in FIG. 119 (SEQ ID NO:300). Clone UNQ528 (DNA58848-1383) contains a single open reading frame with an apparent translational initiation site at nucleotide positions 133–135 and ending at the stop codon at nucleotide positions 1708–1710 (FIG. 119). The predicted polypeptide precursor is 525 amino acids long (FIG. 120). The full-length PRO1071 protein shown in FIG. 120 has an estimated molecular weight of about 58,416 daltons and a pI of about 6.62. Analysis of the full-length PRO1071 sequence shown in FIG. 120 (SEQ ID NO:301) evidences the presence of the following: a signal peptide from about amino acid 1 to about amino acid 25, a potential N-glycosylation site from about amino acid 251 to about amino acid 254, a thrombospondin-1 homology block from about amino acid 385 to about amino acid 399 and von Willibrands factor type C homology blocks from about amino acid 385 to about amino acid 399, from about amino acid 445 to about amino acid 459 and from about amino acid 42 to about amino acid 56. Clone UNQ528 (DNA58847-1383) has been deposited with ATCC on May 20, 1998 and is assigned ATCC deposit no. 209879.

Analysis of the amino acid sequence of the full-length PRO1071 polypeptide suggests that it possesses significant sequence similarity to the thrombospondin protein, thereby indicating that PRO1071 may be a novel thrombospondin homolog. More specifically, an analysis of the Dayhoff database (version 35.45 SwissProt 35) evidenced significant homology between the PRO1071 amino acid sequence and the following Dayhoff sequences, AB002364_1, D67076_1, BTPCINPGN_1, CET13H10_1, CEF25H8_5, CEF53B6_2, CEC26C6_6, HSSEMG_1, CET21B6_4 and BTY08561_1.

Example 48

Isolation of cDNA Clones Encoding Human PRO1072

A consensus sequence was obtained relative to a variety of EST sequences as described in Example 1 above, wherein the consensus sequence obtained is herein designated DNA53125. Based on the DNA53125 consensus sequence, oligonucleotides were synthesized: 1) to identify by PCR a cDNA library that contained the sequence of interest, and 2) for use as probes to isolate a clone of the full-length coding sequence for PRO1072.

PCR primers (forward and reverse) were synthesized:

```
forward PCR primer
5'-CCAGGAAATGCTCCAGGAAGAGCC-3'       (SEQ ID NO:305)

reverse PCR primer
5'-GCCCATGACACCAAATTGAAGAGTGG-3'     (SEQ ID NO:306)
```

Additionally, a synthetic oligonucleotide hybridization probe was constructed from the consensus DNA53125 sequence which had the following nucleotide sequence

```
hybridization probe                            (SEQ ID NO:307)
5'-AACGCAGGGATCTTCCAGTGCCCTTACATGAAGACTGAAGATGGG-3'
```

In order to screen several libraries for a source of a full-length clone, DNA from the libraries was screened by PCR amplification with the PCR primer pair identified above. A positive library was then used to isolate clones encoding the PRO1072 gene using the probe oligonucleotide and one of the PCR primers. RNA for construction of the cDNA libraries was isolated from human fetal lung tissue (LIB26).

DNA sequencing of the clones isolated as described above gave the full-length DNA sequence for PRO1072 [herein designated as UNQ529 (DNA58747-1384)] (SEQ ID NO:302) and the derived protein sequence for PRO1072.

The entire nucleotide sequence of UNQ529 (DNA58747-1384) is shown in FIG. 121 (SEQ ID NO:302). Clone UNQ529 (DNA58747-1384) contains a single open reading frame with an apparent translational initiation site at nucleotide positions 65–67 and ending at the stop codon at nucleotide positions 1073–1075 (FIG. 121). The predicted polypeptide precursor is 336 amino acids long (FIG. 122). The full-length PRO1072 protein shown in FIG. 122 has an estimated molecular weight of about 36,865 daltons and a pI of about 9.15. Analysis of the full-length PRO1072 sequence shown in FIG. 122 (SEQ ID NO:303) evidences the presence of the following: a signal peptide from about amino acid 1 to about amino acid 21, short-chain alcohol dehydrogenase protein homology blocks from about amino acid 134 to about amino acid 144, from about amino acid 44 to about amino acid 56 and from about amino acid 239 to about amino acid 248 and potential N-glycosylation sites from about amino acid 212 to about amino acid 215 and from about amino acid 239 to about amino acid 242. Clone UNQ529 (DNA58747-1384) has been deposited with ATCC on May 14, 1998 and is assigned ATCC deposit no. 209868.

Analysis of the amino acid sequence of the full-length PRO1072 polypeptide suggests that it possesses significant sequence similarity to the reductase family of proteins, thereby indicating that PRO1072 may be a novel reductase. More specifically, an analysis of the Dayhoff database (version 35.45 SwissProt 35) evidenced significant homology between the PRO1072 amino acid sequence and the following Dayhoff sequences, P_W03198, P_W15759, P_R60800, MTV037_3, CEC15H11_6, ATAC00234314, MTV022_13, SCU43704_1, OXIR_STRAT AND CELC01G8_3.

Example 49

Isolation of cDNA Clones Encoding Human PRO1075

A consensus sequence was obtained relative to a variety of EST sequences as described in Example 1 above, wherein the consensus sequence obtained is herein designated DNA34363. Based on the DNA34363 sequence, oligonucleotides were synthesized: 1) to identify by PCR a cDNA library that contained the sequence of interest, and 2) for use as probes to isolate a clone of the full-length coding sequence for PRO1075.

PCR primers (forward and reverse) were synthesized:

```
forward PCR primer
5'-TGAGAGGCCTCTCTGGAAGTTG-3'     (SEQ ID NO:312)

forward PCR primer
5'-GTCAGCGATCAGTGAAAGC-3'        (SEQ ID NO:313)

forward PCR primer
5'-CCAGAATGAAGTAGCTCGGC-3'       (SEQ ID NO:314)

forward PCR primer
5'-CCGACTCAAAATGCATTGTC-3'       (SEQ ID NO:315)

forward PCR primer
5'-CATTTGGCAGGAATTGTCC-3'        (SEQ ID NO:316)

forward PCR primer
5'-GGTGCTATAGGCCAAGGG-3'         (SEQ ID NO:317)

reverse PCR primer
5'-CTGTATCTCTGGGCTATGTCAGAG-3'   (SEQ ID NO:318)

reverse PCR primer
5'-CTACATATAATGGCACATGTCAGCC-3'  (SEQ ID NO:319)
```

Additionally, a synthetic oligonucleotide hybridization probe was constructed from the consensus DNA34363 sequence which had the following nucleotide sequence

```
hybridization probe                    (SEQ ID NO:320)
5'-
CGTCTTCCTATCCTTACCCGACCTCAGATGCTCCCTTCTGCTCCTG-3'
```

In order to screen several libraries for a source of a full-length clone, DNA from the libraries was screened by PCR amplification with the PCR primer pair identified above. A positive library was then used to isolate clones encoding the PRO1075 gene using the probe oligonucleotide and one of the PCR primers. RNA for construction of the cDNA libraries was isolated from human skin tumor tissue (LIB324).

DNA sequencing of the clones isolated as described above gave the full-length DNA sequence for PRO1075 [herein designated as UNQ532 (DNA57689-1385)] (SEQ ID NO:308) and the derived protein sequence for PRO1075.

The entire nucleotide sequence of UNQ532 (DNA57689-1385) is shown in FIG. 124 (SEQ ID NO:308). Clone UNQ532 (DNA57689-1385) contains a single open reading frame with an apparent translational initiation site at nucleotide positions 137–139 and ending at the stop codon at nucleotide positions 1355–1357 (FIG. 124). The predicted polypeptide precursor is 406 amino acids long (FIG. 125). The full-length PRO1075 protein shown in FIG. 125 has an estimated molecular weight of about 46,927 daltons and a pI of about 5.21. Analysis of the full-length PRO1075 sequence shown in FIG. 125 (SEQ ID NO:309) evidences the presence of the following: a signal peptide from about amino acid 1 to about amino acid 29, an endoplasmic reticulum targeting sequence from about amino acid 403 to about amino acid 406, a tyrosine kinase phosphorylation site from about amino acid 203 to about amino acid 211 and a sequence block having homology to the thioredoxin family of proteins from about amino acid 50 to about amino acid 66. Clone UNQ532 (DNA57689-1385) has been deposited with ATCC on May 14, 1998 and is assigned ATCC deposit no. 209869.

Analysis of the amino acid sequence of the full-length PRO1075 polypeptide suggests that it possesses significant sequence similarity to protein disulfide isomerase, thereby indicating that PRO1075 may be a novel protein disulfide isomerase. More specifically, an analysis of the Dayhoff database (version 35.45 SwissProt 35) evidenced significant homology between the PRO1075 amino acid sequence and the following Dayhoff sequences, CELC30H7_2, CELC06A6_3, CELF42G8_3, S57942, ER72_CAEEL, CELC07A12_3, CEH06O01_4 and P_R51696.

Example 50

Isolation of cDNA Clones Encoding Human PRO181

A cDNA sequence isolated in the amylase screen described in Example 2 above was found, by BLAST and FastA sequence alignment, to have sequence homology to a nucleotide sequence encoding the cornichon protein. This cDNA sequence is herein designated DNA13242 (FIG. 130; SEQ ID NO:323). Based on the sequence homology, oligonucleotide probes were generated from the sequence of the DNA13242 molecule and used to screen a human placenta (LIB89) library prepared as described in paragraph 1 of Example 2 above. The cloning vector was pRK5B (pRK5B is a precursor of pRK5D that does not contain the SfiI site; see, Holmes et al., *Science,* 253:1278–1280 (1991)), and the cDNA size cut was less than 2800 bp.

The oligonucleotide probes employed included:

```
forward PCR primer    5'-GTGCAGCAGAGTGGCTTACA-3'                              (SEQ ID NO:326)

reverse PCR primer    5'-ACTGGACCAATTCTTCTGTG-3'                              (SEQ ID NO:327)

hybridization probe  5'-GATATTCTAGCATATTGTCAGAAGGAAGGATGGTGCAAATTAGCT-3'     (SEQ ID NO:328)
```

A full length clone was identified that contained a single open reading frame with an apparent translational initiation site at nucleotide positions 14–16 and ending at the stop codon found at nucleotide positions 446–448 (FIG. 128; SEQ ID NO:321). The predicted polypeptide precursor is 144 amino acids long, has a calculated molecular weight of approximately 16,699 daltons and an estimated pI of approximately 5.6. Analysis of the full-length PRO181 sequence shown in FIG. 129 (SEQ ID NO:322) evidences the presence of the following: a signal peptide from about amino acid 1 to about amino acid 20, a putative type II transmembrane domain from about amino acid 11 to about amino acid 31 and other transmembrane domains from about amino acid 57 to about amino acid 77 and from about amino acid 123 to about amino acid 143. Clone UNQ155 (DNA23330-1390) has been deposited with ATCC on Apr. 14, 1998 and is assigned ATCC deposit no. 209775.

Analysis of the amino acid sequence of the full-length PRO181 polypeptide suggests that it possesses significant sequence similarity to the cornichon protein, thereby indicating that PRO181 may be a novel cornichon homolog. More specifically, an analysis of the Dayhoff database (version 35.45 SwissProt 35) evidenced significant homology between the PRO181 amino acid sequence and the following Dayhoff sequences, AF022811_1, CET09E8_3, S64058, YGF4_YEAST, YB60_YEAST, EBU89455_1, SIU36383_3, and PH1371.

Example 51

Isolation of cDNA Clones Encoding Human PRO195

A cDNA sequence was isolated in the amylase screen described in Example 2 above and is herein designated DNA13199 (FIG. 134; SEQ ID NO:332). The DNA13199 sequence was then compared to a variety of expressed sequence tag (EST) databases which included public EST databases (e.g., GenBank) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is herein designated as DNA22778.

Based on the DNA22778 sequence, oligonucleotide probes were generated and used to screen a human placenta library (LIB89) prepared as described in paragraph 1 of Example 2 above. The cloning vector was pRK5B (pRK5B is a precursor of pRK5D that does not contain the SfiI site; see, Holmes et al., *Science*, 253:1278–1280 (1991)), and the cDNA size cut was less than 2800 bp.

PCR primers (forward and reverse) were synthesized:

```
forward PCR primer
5'-ACAAGCTGAGCTGCTGTGACAG-3'       (SEQ ID NO:333)

reverse PCR primer
5'-TGATTCTGGCAACCAAGATGGC-3'       (SEQ ID NO:334)
```

Additionally, a synthetic oligonucleotide hybridization probe was constructed from the DNA22778 sequence which had the following nucleotide sequence

```
hybridization probe                         (SEQ ID NO:335)
5'-ATGGCCTTGGCCGGAGGTTCGGGGACCGCTTCGGCTGAAG-3'
```

In order to screen several libraries for a source of a full-length clone, DNA from the libraries was screened by PCR amplification with the PCR primer pair identified above. A positive library was then used to isolate clones encoding the PRO195 gene using the probe oligonucleotide and one of the PCR primers.

A full length clone was identified that contained a single open reading frame with an apparent translational initiation site at nucleotide positions 70–72 and ending at the stop codon found at nucleotide positions 1039–1041 (FIG. 132; SEQ ID NO:330). The predicted polypeptide precursor is 323 amino acids long, has a calculated molecular weight of approximately 36,223 daltons and an estimated pI of approximately 5.06. Analysis of the full-length PRO195 sequence shown in FIG. 132 (SEQ ID NO:330) evidences the presence of the following: a signal peptide from about amino acid 1 to about amino acid 31, a transmembrane domain from about amino acid 241 to about amino acid 260 and a potential N-glycosylation site from about amino acid 90 to about amino acid 93. Clone UNQ169 (DNA26847-1395) has been deposited with ATCC on Apr. 14, 1998 and is assigned ATCC deposit no. 209772.

Analysis of the amino acid sequence of the full-length PRO195 polypeptide suggests that it possesses no significant sequence similarity to any known protein. However, an analysis of the Dayhoff database (version 35.45 SwissProt 35) evidenced some degree of homology between the PRO195 amino acid sequence and the following Dayhoff sequences, P_P91380, AF035118_1, HUMTROPCS_1, NUOD_SALTY and E70002.

Example 52

Isolation of cDNA Clones Encoding Human PRO865

A cDNA sequence isolated in the amylase screen described in Example 2 above was herein designated DNA37642 (FIG. 137, SEQ ID NO:506). The DNA37642 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify homologies therebetween. The homology search was performed using the computer program BLAST or BLAST2 (Altshul et al., *Methods in Enzymology* 266: 460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained is herein designated DNA48615.

Based on the DNA48615 consensus sequence, probes were generated and used to screen a human fetal kidney (LIB227) library prepared as described in paragraph 1 of Example 2 above. The cloning vector was pRK5B (pRK5B is a precursor of pRK5D that does not contain the SfiI site; see, Holmes et al., *Science,* 253:1278–1280 (1991)), and the cDNA size cut was less than 2800 bp.

PCR primers (forward and reverse) were synthesized:

```
forward PCR primer 1
5'-AAGCTGCCGGAGCTGCAATG-3'        (SEQ ID NO:339)

forward PCR primer 2
5'-TTGCTTCTTAATCCTGAGCGC-3'       (SEQ ID NO:340)

forward PCR primer 3
5'-AAAGGAGGACTTTCGACTGC-3'        (SEQ ID NO:341)

reverse PCR primer 1
5'-AGAGATTCATCCACTGCTCCAAGTCG-3'  (SEQ ID NO:342)

reverse PCR primer 2
5'-TGTCCAGAAACAGGCACATATCAGC-3'   (SEQ ID NO:343)
```

Additionally, a synthetic oligonucleotide hybridization probe was constructed from the consensus DNA48615 sequence which had the following nucleotide sequence

```
hybridization probe                (SEQ ID NO:344)
5'-
AGACAGCGGCACAGAGGTGCTTCTGCCAGGTTAGTGGTTACTTGGATGAT-
3'
```

In order to screen several libraries for a source of a full-length clone, DNA from the libraries was screened by PCR amplification with the PCR primer pairs identified above. A positive library was then used to isolate clones encoding the PRO865 gene using the probe oligonucleotide and one of the PCR primers.

A full length clone was identified that contained a single open reading frame with an apparent translational initiation site at nucleotide positions 173–175 and ending at the stop codon found at nucleotide positions 1577–1579 (FIG. 135; SEQ ID NO:336). The predicted polypeptide precursor is 468 amino acids long, has a calculated molecular weight of approximately 54,393 daltons and an estimated pI of approximately 5.63. Analysis of the full-length PRO865 sequence shown in FIG. 136 (SEQ ID NO:337) evidences the presence of the following: a signal peptide from about amino acid 1 to about amino acid 23, potential N-glycosylation sites from about amino acid 280 to about amino acid 283 and from about amino acid 384 to about amino acid 387, a potential amidation site from about amino acid 94 to about amino acid 97, glycosaminoglycan attachment sites from about amino acid 20 to about amino acid 23 and from about amino acid 223 to about amino acid 226, an aminotransferase class-V pyridoxyl-phosphate amino acid sequence block from about amino acid 216 to about amino acid 222 and an amino acid sequence block similar to that found in the interleukin-7 protein from about amino acid 338 to about amino acid 343. Clone UNQ434 (DNA53974-1401) has been deposited with ATCC on Apr. 14, 1998 and is assigned ATCC deposit no. 209774.

Analysis of the amino acid sequence of the full-length PRO865 polypeptide suggests that it possesses no significant sequence similarity to any known protein. However, an analysis of the Dayhoff database (version 35.45 SwissProt 35) evidenced some degree of homology between the PRO865 amino acid sequence and the following Dayhoff sequences, YMN0_YEAST, ATFCA4_43, S44168, P_W14549 and RABTCRG4_1.

Example 53

Isolation of cDNA Clones Encoding Human PRO827

A cDNA sequence isolated in the amylase screen described in Example 2 above was found, by BLAST and FastA sequence alignment, to have sequence homology to nucleotide sequences encoding various integrin proteins. This cDNA sequence is herein designated DNA47751 (see FIG. 140; SEQ ID NO:347). Based on the sequence homology, probes were generated from the sequence of the DNA47751 molecule and used to screen a human fetal pigment epithelium library (LIB113) prepared as described in paragraph 1 of Example 2 above. The cloning vector was pRK5B (pRK5B is a precursor of pRK5D that does not contain the SfiI site; see, Holmes et al., *Science,* 253: 1278–1280 (1991)), and the cDNA size cut was less than 2800 bp.

PCR primers (forward and reverse) were synthesized:

```
forward PCR primer
5'-AGGGACAGAGGCCAGAGGACTTC-3'    (SEQ ID NO:348)

reverse PCR primer
5'-CAGGTGCATATTCACAGCAGGATG-3'   (SEQ ID NO:349)
```

Additionally, a synthetic oligonucleotide hybridization probe was constructed from the consensus DNA47751 sequence which had the following nucleotide sequence

```
hybridization probe                          (SEQ ID NO:350)
5'-GGAACTCCCCTTCGTCACTCACCTGTTCTTGCCCCTGGTGTTCCT-3'
```

In order to screen several libraries for a source of a full-length clone, DNA from the libraries was screened by PCR amplification with the PCR primer pair identified above. A positive library was then used to isolate clones encoding the PRO827 gene using the probe oligonucleotide and one of the PCR primers.

A full length clone was identified that contained a single open reading frame with an apparent translational initiation site at nucleotide positions 134–136 and ending at the stop codon found at nucleotide positions 506–508 (FIG. 138; SEQ ID NO:345). The predicted polypeptide precursor is 124 amino acids long, has a calculated molecular weight of approximately 13,352 daltons and an estimated pI of approximately 5.99. Analysis of the full-length PRO827 sequence shown in FIG. 139 (SEQ ID NO:346) evidences the presence of the following: a signal peptide from about amino acid 1 to about amino acid 22, a cell attachment sequence from about amino acid 70 to about amino acid 72, a potential N-glycosylation site from about amino acid 98 to about amino acid 101 and an integrin alpha chain protein homology sequence from about amino acid 67 to about amino acid 81. Clone UNQ468 (DNA57039-1402) has been deposited with ATCC on Apr. 14, 1998 and is assigned ATCC deposit no. 209777.

Analysis of the amino acid sequence of the full-length PRO827 polypeptide suggests that it possesses significant sequence similarity to the VLA-2 integrin protein and various other integrin proteins, thereby indicating that PRO827 may be a novel integrin or splice variant thereof. More specifically, an analysis of the Dayhoff database (version 35.45 SwissProt 35) evidenced significant homology between the PRO240 amino acid sequence and the following Dayhoff sequences, S44142, ITA2_HUMAN, ITA1_RAT, ITA1_HUMAN, ITA4_HUMAN, ITA9_HUMAN, AF032108_1, ITAM_MOUSE, ITA8_CHICK and ITA6_CHICK.

Example 54

Isolation of cDNA Clones Encoding Human PRO1114

A cDNA sequence isolated in the amylase screen described in Example 2 was found, by the WU-BLAST2 sequence alignment computer program, to have certain sequence identity to other known interferon receptors. This cDNA sequence is herein designated DNA48466 (FIG. 143; SEQ ID NO:352). Based on the sequence identity, probes were generated from the sequence of the DNA48466 molecule and used to screen a human breast carconoma library (LIB135) prepared as described in paragraph 1 of Example 2 above. The cloning vector was pRK5B (pRK5B is a precursor of pRK5D that does not contain the SfiI site; see, Holmes et al., Science, 253:1278–1280 (1991)), and the cDNA size cut was less than 2800 bp.

The oligonucleotide probes employed were as follows:

```
forward PCR primer
5'-AGGCTTCGCTGCGACTAGACCTC-3'                              (SEQ ID NO:354)

reverse PCR primer
5'-CCAGGTCGGGTAAGGATGGTTGAG-3'                             (SEQ ID NO:355)

hybridization probe
5'-TTTCTACGCATTGATTCCATGTTTGCTCACAGATGAAGTGGCCATTCTGC-3'   (SEQ ID NO:356)
```

A full length clone was identified that contained a single open reading frame with an apparent translational initiation site at nucleotide positions 250–252, and a stop signal at nucleotide positions 1183–1185 (FIG. 141, SEQ ID NO:351). The predicted polypeptide precursor is 311 amino acids long, has a calculated molecular weight of approximately 35,076 daltons and an estimated pI of approximately 5.04. Analysis of the full-length PRO1114 interferon receptor sequence shown in FIG. 142 (SEQ ID NO:352) evidences the presence of the following: a signal peptide from about amino acid 1 to about amino acid 29, a transmembrane domain from about amino acid 230 to about amino acid 255, potential N-glycosylation sites from about amino acid 40 to about amino acid 43 and from about amino acid 134 to about amino acid 137, an amino acid sequence block having homology to tissue factor proteins from about amino acid 92 to about amino acid 119 and an amino acid sequence block having homology to integrin alpha chain proteins from about amino acid 232 to about amino acid 262. Clone UNQ557 (DNA57033-1403) has been deposited with ATCC on May 27, 1998 and is assigned ATCC deposit no. 209905.

An analysis of the Dayhoff database (version 35.45 SwissProt 35), using a WU-BLAST2 sequence alignment analysis of the full-length sequence shown in FIG. 142 (SEQ ID NO:352), evidenced significant homology between the PRO1114 interferon receptor amino acid sequence and the following Dayhoff sequences: G01418, INR1_MOUSE, P_R71035, INGS_HUMAN, A26595_1, A26593_1, I156215 and TF_HUMAN.

Example 55

Isolation of cDNA Clones Encoding Human PRO237

A consensus sequence was obtained relative to a variety of EST sequences as described in Example 1 above, wherein the consensus sequence obtained is herein designated DNA30905. Based on the DNA30905 consensus sequence, oligonucleotides were synthesized: 1) to identify by PCR a cDNA library that contained the sequence of interest, and 2) for use as probes to isolate a clone of the full-length coding sequence for PRO237.

PCR primers (forward and reverse) were synthesized:

```
forward PCR primer
5'-TCTGCTGAGGTGCAGCTCATTCAC-3'     (SEQ ID NO:359)

reverse PCR primer
5'-GAGGCTCTGGAAGATCTGAGATGG-3'     (SEQ ID NO:360)
```

Additionally, a synthetic oligonucleotide hybridization probe was constructed from the consensus DNA30905 sequence which had the following nucleotide sequence

```
hybridization probe                 (SEQ ID NO:361)
5'-
GCCTCTTTGTCAACGTTGCCAGTACCTCTAACCCATTCCTCAGTCGCCTC-
3'
```

In order to screen several libraries for a source of a full-length clone, DNA from the libraries was screened by PCR amplification with the PCR primer pair identified above. A positive library was then used to isolate clones encoding the PRO237 gene using the probe oligonucleotide and one of the PCR primers. RNA for construction of the cDNA libraries was isolated from human fetal brain tissue (LIB153).

DNA sequencing of the clones isolated as described above gave the full-length DNA sequence for PRO237 [herein designated as UNQ211 (DNA34353-1428)] (SEQ ID NO:357) and the derived protein sequence for PRO237.

The entire nucleotide sequence of UNQ211 (DNA34353-1428) is shown in FIG. 144 (SEQ ID NO:357). Clone UNQ211 (DNA34353-1428) contains a single open reading frame with an apparent translational initiation site at nucleotide positions 586–588 and ending at the stop codon at nucleotide positions 1570–1572 (FIG. 144). The predicted polypeptide precursor is 328 amino acids long (FIG. 145). The full-length PRO237 protein shown in FIG. 145 has an estimated molecular weight of about 36,238 daltons and a pI of about 9.90. Analysis of the full-length PRO237 sequence shown in FIG. 145 (SEQ ID NO:358) evidences the presence of the following: a signal peptide from about amino acid 1 to about amino acid 23, a transmembrane domain from about amino acid 177 to about amino acid 199, potential N-glycosylation sites from about amino acid 118 to about amino acid 121, from about amino acid 170 to about amino acid 173 and from about amino acid 260 to about amino acid 263 and eukaryotic-type carbonic anhydrase sequence homology blocks from about amino acid 222 to about amino acid 270, from about amino acid 128 to about amino acid 164 and from about amino acid 45 to about amino acid 92. Clone UNQ211 (DNA34353-1428) has been deposited with ATCC on May 12, 1998 and is assigned ATCC deposit no. 209855.

Analysis of the amino acid sequence of the full-length PRO237 polypeptide suggests that it possesses significant sequence similarity to the carbonic anhydrase protein. More specifically, an analysis of the Dayhoff database (version 35.45 SwissProt 35) evidenced significant homology between the PRO237 amino acid sequence and the following Dayhoff sequences, AF050106_1, OACALP_1, CELD1022_8, CAH2_HUMAN, 1CAC, CAH5_HUMAN, CAHP_HUMAN, CAH3_HUMAN, CAH1_HUMAN and 2CAB.

Example 56

Isolation of cDNA Clones Encoding Human PRO541

A consensus sequence was obtained relative to a variety of EST sequences as described in Example 1 above, wherein the consensus sequence obtained is herein designated DNA42259. Based on the DNA42259 consensus sequence, oligonucleotides were synthesized: 1) to identify by PCR a cDNA library that contained the sequence of interest, and 2) for use as probes to isolate a clone of the full-length coding sequence for PRO541.

PCR primers (forward and reverse) were synthesized:

```
forward PCR primer
5'-GGACAGAATTTGGGAGCACACTGG-3'      (SEQ ID NO:364)

forward PCR primer
5'-CCAAGAGTATACTGTCCTCG-3'          (SEQ ID NO:365)

reverse PCR primer
5'-AGCACAGATTTTCTCTACAGCCCCC-3'     (SEQ ID NO:366)

reverse PCR primer
5'-AACCACTCCAGCATGTACTGCTGC-3'      (SEQ ID NO:367)
```

Additionally, a synthetic oligonucleotide hybridization probe was constructed from the consensus DNA42259 sequence which had the following nucleotide sequence

```
hybridization probe                 (SEQ ID NO:368)
5'-
CCATTCAGGTGTTCTGGCCCTGTATGTACACATTATACACAGGTCGTGTG-
3'
```

In order to screen several libraries for a source of a full-length clone, DNA from the libraries was screened by PCR amplification with one of the PCR primer pairs identified above. A positive library was then used to isolate clones encoding the PRO541 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO541 [herein designated as UNQ342 (DNA45417-1432)] (SEQ ID NO:362) and the derived protein sequence for PRO541.

The entire nucleotide sequence of UNQ342 (DNA45417-1432) is shown in FIG. 146 (SEQ ID NO:362). Clone UNQ342 (DNA45417-1432) contains a single open reading frame with an apparent translational initiation site at nucleotide positions 469–471 and ending at the stop codon at nucleotide positions 1969–1971 (FIG. 146). The predicted polypeptide precursor is 500 amino acids long (FIG. 147). The full-length PRO541 protein shown in FIG. 147 has an estimated molecular weight of about 56,888 daltons and a pI of about 8.53. Analysis of the full-length PRO541 sequence shown in FIG. 147 (SEQ ID NO:363) evidences the presence of the following: a signal peptide from about amino acid 1 to about amino acid 20, amino acid sequence blocks having homology to extracellular proteins SCP/Tpx-1/Ag5/PR-1/Sc7 from about amino acid 165 to about amino acid 186, from about amino acid 196 to about amino acid 218, from about amino acid 134 to about amino acid 146, from about amino acid 96 to about amino acid 108 and from about amino acid 58 to about amino acid 77 and a potential N-glycosylation site from about amino acid 28 to about amino acid 31. Clone UNQ342 (DNA45417-1432) has been deposited with ATCC on May 27, 1998 and is assigned ATCC deposit no. 209910.

Analysis of the amino acid sequence of the full-length PRO541 polypeptide suggests that it possesses significant sequence similarity to a trypsin inhibitor protein, thereby indicating that PRO541 may be a novel trypsin inhibitor. More specifically, an analysis of the Dayhoff database (version 35.45 SwissProt 35) evidenced significant homology between the PRO541 amino acid sequence and the following Dayhoff sequences, D45027_1, AB009609_1, JC5308, CRS3_HORSE, TPX1_HUMAN, HELO-_HELHO, GEN14351, A28112_1, CET05A10_4 and P_W11485.

Example 57

Isolation of cDNA Clones Encoding Human PRO273

A consensus sequence was obtained relative to a variety of EST sequences as described in Example 1 above, wherein the consensus sequence obtained is herein designated DNA36465. Based on the DNA36465 consensus sequence, oligonucleotides were synthesized: 1) to identify by PCR a cDNA library that contained the sequence of interest, and 2) for use as probes to isolate a clone of the full-length coding sequence for PRO273.

A pair of PCR primers (forward and reverse) were synthesized:

```
forward PCR primer
5'-CAGCGCCCTCCCCATGTCCCTG-3'      (SEQ ID NO:371)

reverse PCR primer
5'-TCCCAACTGGTTTGGAGTTTTCCC-3'    (SEQ ID NO:372)
```

Additionally, a synthetic oligonucleotide hybridization probe was constructed from the consensus DNA36465 sequence which had the following nucleotide sequence

```
hybridization probe                (SEQ ID NO:373)
5'-CTCCGGTCAGCATGAGGCTCCTGGCGGCCGCTGCTCCTGCTGCTG-3'
```

In order to screen several libraries for a source of a full-length clone, DNA from the libraries was screened by PCR amplification with the PCR primer pair identified above. A positive library was then used to isolate clones encoding the PRO273 gene using the probe oligonucleotide and one of the PCR primers. RNA for construction of the cDNA libraries was isolated from human fetal kidney tissue.

DNA sequencing of the clones isolated as described above gave the full-length DNA sequence for PRO273 [herein designated as UNQ240 (DNA39523-1192)] (SEQ ID NO:369) and the derived protein sequence for PRO273.

The entire nucleotide sequence of UNQ240 (DNA39523-1192) is shown in FIG. 148 (SEQ ID NO:369). Clone UNQ240 (DNA39523-1192) contains a single open reading frame with an apparent translational initiation site at nucleotide positions 167–169 and ending at the stop codon at nucleotide positions 500–502 (FIG. 148). The predicted polypeptide precursor is 111 amino acids long (FIG. 149). Clone UNQ240 (DNA39523-1192) has been deposited with the ATCC. It is understood that the deposited clone contains the actual sequence and that the sequences provided herein are merely representative based on current sequencing techniques. Moreover, given the sequences provided herein and knowledge of the universal genetic code, the corresponding nucleotides for any given amino acid can be routinely identified and vice versa.

Analysis of the amino acid sequence of the full-length PRO273 polypeptide suggests that portions of it possess sequence identity with human macrophage inflammatory protein-2, cytokine-induced neutrophil chemoattractant 2, and neutrophil chemotactic factor 2-beta, thereby indicating that PRO273 is a novel chemokine.

As discussed further below, the cDNA was subcloned into a baculovirus vector and expressed in insect cells as a C-terminally tagged IgG fusion protein. N-terminal sequencing of the resultant protein identified the signal sequence cleavage site, yielding a mature polypeptide of 77 amino acids. The mature sequence, showing 31–40% identity to other human CXC chemokines, includes the four canonical cysteine residues but lacks the ELR motif. Northern analysis demonstrates expression at least in the small intestine, colon, spleen, lymph node and kidney. By in situ hybridization, also described in detail below, mRNA is localized to the lamina propria of intestinal villi and to renal tubules.

Example 58

Isolation of cDNA Clones Encoding Human PRO701

A consensus sequence was obtained relative to a variety of EST sequences as described in Example 1 above, wherein the consensus sequence obtained is herein designated DNA39848. Based on the DNA39848 consensus sequence, oligonucleotides were synthesized: 1) to identify by PCR a cDNA library that contained the sequence of interest, and 2) for use as probes to isolate a clone of the full-length coding sequence for PRO701.

A pair of PCR primers (forward and reverse) were synthesized:

```
forward PCR primer
5'-GGCAAGCTACGGAAACGTCATCGTG-3'   (SEQ ID NO:376)

reverse PCR primer
5'-AACCCCCGAGCCAAAAGATGGTCAC-3'   (SEQ ID NO:377)
```

Additionally, a synthetic oligonucleotide hybridization probe was constructed from the consensus DNA39848 sequence which had the following nucleotide sequence:

```
hybridization probe                (SEQ ID NO:378)
5'-
GTACCGGTGACCAGGCAGCAAAAGGCAACTATGGGCTCCTGGATCAG-3'.
```

In order to screen several libraries for a source of a full-length clone, DNA from the libraries was screened by PCR amplification with the PCR primer pair identified above. A positive library was then used to isolate clones encoding the PRO701 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO701 [herein designated as UNQ365 (DNA44205-1285)] (SEQ ID NO:374) and the derived protein sequence for PRO701.

The entire nucleotide sequence of UNQ365 (DNA44205-1285) is shown in FIG. 150 (SEQ ID NO:374). Clone UNQ365 (DNA44205-1285) contains a single open reading frame with an apparent translational initiation site at nucleotide positions 50–52 and ending at the stop codon at nucleotide positions 2498–3000 (FIG. 150). The predicted polypeptide precursor is 816 amino acids long (FIG. 151). The full-length PRO701 protein shown in FIG. 151 has an estimated molecular weight of about 91,794 daltons, a pI of about 5.88 and NX(S/T) being 4. Clone UNQ365 (DNA44205-1285) has been deposited with the ATCC on Mar. 31, 1998. It is understood that the clone was the correct and actual sequence, wherein the sequences provided herein are representative based on sequencing techniques.

Still regarding the amino acid sequence shown in FIG. 151, there is a potential signal peptide cleavage site at about amino acid 25. There are potential N-glycosylation sites at about amino acid positions 83, 511, 716 and 803. The carboxylesterases type-B signature 2 sequence is at about residues 125 to 135. Regions homologous with carboxylesterase type-B are also at about residues 54–74, 197–212 and 221–261. A potential transmembrane region corresponds approximately to amino acids 671 through about 700. The corresponding nucleic acids can be routinely determined from the sequences provided herein.

Analysis of the amino acid sequence of the full-length PRO701 polypeptide suggests that it possess significant homology to the neuroligins from *rattus norvegicus* indicating that PRO701 may be a novel human neuroligin.

Example 59

Isolation of cDNA Clones Encoding Human PRO704

A consensus sequence was obtained relative to a variety of EST sequences as described in Example 1 above, wherein the consensus sequence obtained is herein designated DNA43033. Based on the DNA43033 consensus sequence, oligonucleotides were synthesized: 1) to identify by PCR a cDNA library that contained the sequence of interest, and 2) for use as probes to isolate a clone of the full-length coding sequence for PRO704.

A pair of PCR primers (forward and reverse) were synthesized:

```
forward PCR primer
5'-CCTTGGGTCGTGGCAGCAGTGG-3';      (SEQ ID NO:381)

reverse PCR primer
5'-CACTCTCCAGGCTGCATGCTCAGG-3'.    (SEQ ID NO:382)
```

Additionally, a synthetic oligonucleotide hybridization probe was constructed from the DNA43033 consensus sequence which had the following nucleotide sequence:

```
hybridization probe              (SEQ ID NO:383)
5'-GTCAAACGTTCGAGTACTTGAAACGGGAGCACTCGCTGTCGAAGC-
3'.
```

In order to screen several libraries for a source of a full-length clone, DNA from the libraries was screened by PCR amplification with the PCR primer pair identified above. A positive library was then used to isolate clones encoding the PRO704 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO704 [herein designated as UNQ368 (DNA50911-1288)] (SEQ ID NO:379) and the derived protein sequence for PRO704.

The entire nucleotide sequence of UNQ368 (DNA50911-1288) is shown in FIG. 152 (SEQ ID NO:379). Clone UNQ368 (DNA50911-1288) contains a single open reading frame with an apparent translational initiation site at nucleotide positions 8–10 and ending at the stop codon at nucleotide positions 1052–1054 (FIG. 152). The predicted polypeptide precursor is 348 amino acids long (FIG. 153). The full-length PRO704 protein shown in FIG. 153 has an estimated molecular weight of about 39,711 and a pI of about 8.7. Clone UNQ368 (DNA50911-1288) has been deposited with the ATCC on Mar. 31, 1998. Regarding the sequence, it is understood that the deposited clone contains the correct sequence, and the sequences provided herein are based on known sequencing techniques.

Analysis of the amino acid sequence of the full-length PRO704 polypeptide suggests that portions of it possess significant homology to the vesicular integral membrane protein 36, thereby indicating that PRO704 may be a novel vesicular integral membrane protein.

Still analyzing the amino acid sequence of SEQ ID NO:380, the putative signal peptide is at about amino acids 1–39 of SEQ ID NO:380. The transmembrane domain is at amino acids 310–335 of SEQ ID NO:380. A potential N-glycosylation site is at about amino acids 180–183 of SEQ ID NO:380. The corresponding nucleotides can be routinely determined given the sequences provided herein.

Example 60

Isolation of cDNA Clones Encoding Human PRO706

A consensus sequence was obtained relative to a variety of EST sequences as described in Example 1 above, wherein the consensus sequence obtained is herein designated DNA40669. Based on the DNA40669 consensus sequence, oligonucleotides were synthesized: 1) to identify by PCR a cDNA library that contained the sequence of interest, and 2) for use as probes to isolate a clone of the full-length coding sequence for PRO706.

A pair of PCR primers (forward and reverse) were synthesized:

```
forward PCR primer
5'-CCAAGCAGCTTAGAGCTCCAGACC-3'     (SEQ ID NO:386)

reverse PCR primer
5'-TTCCCTATGCTCTGTATTGGCATGG-3'    (SEQ ID NO:387)
```

Additionally, a synthetic oligonucleotide hybridization probe was constructed from the consensus DNA40669 sequence which had the following nucleotide sequence

```
hybridization probe              (SEQ ID NO:388)
5'-
GCCACTTCTGCCACAATGTCAGCTTTCCCTGTACCAGAAATGGCTGTGTT-
3'
```

In order to screen several libraries for a source of a full-length clone, DNA from the libraries was screened by PCR amplification with the PCR primer pair identified above. A positive library was then used to isolate clones encoding the PRO706 gene using the probe oligonucleotide and one of the PCR primers. RNA for construction of the cDNA libraries was isolated from human fetal brain tissue (LIB153).

DNA sequencing of the clones isolated as described above gave the full-length DNA sequence for PRO706 [herein designated as UNQ370 (DNA48329-1290)] (SEQ ID NO:384) and the derived protein sequence for PRO706. It is understood that the deposited clone contains the actual sequence, and that the sequences provided herein are representative based on current sequencing techniques.

The entire nucleotide sequence of UNQ370 (DNA48329-1290) is shown in FIG. 154 (SEQ ID NO:384). Clone UNQ370 (DNA48329-1290) contains a single open reading frame with an apparent translational initiation site at nucleotide positions 279–281 and ending at the stop codon at nucleotide positions 1719–1721 (FIG. 154). The predicted polypeptide precursor is 480 amino acids long (FIG. 155). The full-length PRO706 protein shown in FIG. 155 has an estimated molecular weight of about 55,239 daltons and a pI of about 9.30. Clone UNQ370 (DNA48329-1290) has been deposited with the ATCC on Apr. 21, 1998.

Still regarding the amino acid sequence shown in FIG. 155, there is a potential signal peptide cleavage site at about amino acid 19. There are potential N-glycosylation sites at about amino acid positions 305 and 354. There is a potential tyrosine kinase phosphorylation site at about amino acid position 333. A region homologous with histidine acid phosphatase is at about residues 87–102. The corresponding nucleic acid regions can be routinely determined given the provided sequences, i.e., the codons can be determined from the specifically named amino acids given.

Analysis of the amino acid sequence of the full-length PRO706 polypeptide suggests that portions of it possess significant homology to the human prostatic acid phosphatase precursor thereby indicating that PRO706 may be a novel human prostatic acid phosphatase.

Example 61

Isolation of cDNA Clones Encoding Human PRO707

A consensus sequence was obtained relative to a variety of EST sequences as described in Example 1 above, wherein the consensus sequence obtained is herein designated DNA42775. Based on DNA42775, oligonucleotides were synthesized: 1) to identify by PCR a cDNA library that contained the sequence of interest, and 2) for use as probes to isolate a clone of the full-length coding sequence for PRO707.

A pair of PCR primers (forward and reverse) were synthesized:

```
forward PCR primer
5'-TCCGTCTCTGTGAACCGCCCCAC-3';    (SEQ ID NO:391)

reverse PCR primer
5'-CTCGGGCGCATTGTCGTTCTGGTC-3'.    (SEQ ID NO:392)
```

Additionally, a synthetic oligonucleotide hybridization probe was constructed from the DNA42775 sequence which had the following nucleotide sequence:

```
   hybridization probe           (SEQ ID NO:393).
   5'-CCGACTGTGAAAGAGAACGCCCCAGATCCACTTATTCCCC-3'
```

In order to screen several libraries for a source of a full-length clone, DNA from the libraries was screened by PCR amplification with the PCR primer pair identified above. A positive library was then used to isolate clones encoding the PRO707 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO707 [herein designated as UNQ371 (DNA48306-1291)] (SEQ ID NO:389) and the derived protein sequence for PRO707.

The entire nucleotide sequence of UNQ371 (DNA48306-1291) is shown in FIG. 156 (SEQ ID NO:389). Clone UNQ371 (DNA48306-1291) contains a single open reading frame with an apparent translational initiation site at nucleotide positions 371–373 and ending at the stop codon at nucleotide positions 3119–3121 of SEQ ID NO:389. The predicted polypeptide precursor is 916 amino acids long (FIG. 157). The full-length PRO707 protein shown in FIG. 157 has an estimated molecular weight of about 100,204 daltons and a pI of about 4.92. Clone UNQ371 (DNA48306-1291) has been deposited with ATCC on May 27, 1998. It is understood that the clone UNQ371 which is deposited is that which encodes PRO707, and that the sequences herein are merely representations based on known sequencing techniques which may be subject to minor errors.

Regarding analysis of the amino acid sequence, the signal sequence appears to be at about 1 through 30 of SEQ ID NO:390. Cadherins extracellular repeated domain signature sequence is at about amino acids 121–131, 230–240, 335–345, 440–450, and 550–560 of SEQ ID NO:390. Tyrosine kinase phosphorylation sites are at about amino acids 124–132 and 580–586 of SEQ ID NO:390. A potential transmembrane domain is at about amino acids 682–715±5. The nucleic acid positions can be derived by referring to the corresponding codon for the named amino acid.

Analysis of the amino acid sequence of the full-length PRO707 polypeptide suggests that portions of it possess significant homology to the cadherin FIB3 protein, expressed in human fibroblasts, thereby indicating that PRO707 may be a novel cadherin.

Example 62

Isolation of cDNA Clones Encoding Human PRO322

A consensus sequence was obtained relative to a variety of EST sequences as described in Example 1 above, wherein the consensus sequence obtained is herein designated DNA48336. Based on the DNA48336 consensus sequence, oligonucleotides were synthesized: 1) to identify by PCR a cDNA library that contained the sequence of interest, and 2) for use as probes to isolate a clone of the full-length coding sequence for PRO322.

A pair of PCR primers (forward and reverse) were synthesized:

```
forward PCR primer
5'-CAGCCTACAGAATAAAGATGGCCC-3'    (SEQ ID NO:396)

reverse PCR primer
5'-GGTGCAATGATCTGCCAGGCTGAT-3'    (SEQ ID NO:397)
```

Additionally, a synthetic oligonucleotide hybridization probe was constructed from the DNA48336 consensus sequence which had the following nucleotide sequence:

```
hybridization probe                (SEQ ID NO:398)
5'-
AGAAATACCTGTGGTTCAGTCCATCCCAAACCCCTGCTACAACAGCAG-
3'.
```

In order to screen several libraries for a source of a full-length clone, DNA from the libraries was screened by PCR amplification with the PCR primer pair identified above. A positive library was then used to isolate clones encoding the PRO322 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO322 [herein designated as UNQ283 (DNA48336-1309)] (SEQ ID NO:394) and the derived protein sequence for PRO322. It is understood that UNQ283 (DNA48336-1309) in fact encodes PRO322, and that SEQ ID NO:394 is a representation of the sequence based on sequencing techniques known in the art.

The entire nucleotide sequence of UNQ283 (DNA48336-1309) is shown in FIG. 158 (SEQ ID NO:394). Clone UNQ283 (DNA48336-1309) contains a single open reading frame with an apparent translational initiation site at nucleotide positions 166–168 and ending at the stop codon at nucleotide positions 946–948 (FIG. 158). The predicted polypeptide precursor is 260 amino acids long (FIG. 159). The full-length PRO322 protein shown in FIG. 159 has an estimated molecular weight of about 28,028 daltons and a pI of about 7.87. Clone UNQ283 (DNA48336-1309) has been deposited with ATCC and is assigned ATCC deposit no. 209669.

Regarding the amino acid sequence of FIG. 159, a potential N-glycosylation site is at amino acid 110 of SEQ ID NO:395. The serine proteases, trypsin family and histidine active site is identified at amino acids 69 through 74 of SEQ ID NO:395 and the consensus sequence is identified at amino acids 207 through 217 of SEQ ID NO:395. The kringle domain proteins motif is identified at amino acids 205 through 217 of SEQ ID NO:395. The putative signal peptide is encoded at about amino acids 1–23.

Analysis of the amino acid sequence of the full-length PRO322 polypeptide suggests that portions of it possess significant homology to neuropsin and other serine proteases, thereby indicating that PRO322 is a novel serine protease related to neuropsin.

Example 63

Isolation of cDNA Clones Encoding Human PRO526

A consensus sequence was obtained relative to a variety of EST sequences as described in Example 1 above, wherein the consensus sequence obtained is herein designated DNA39626. Based on the DNA39626 consensus sequence, oligonucleotides were synthesized: 1) to identify by PCR a cDNA library that contained the sequence of interest, and 2) for use as probes to isolate a clone of the full-length coding sequence for PRO526.

A pair of PCR primers (forward and reverse) were synthesized:

```
forward PCR primer
5'-TGGCTGCCCTGCAGTACCTCTACC-3';    (SEQ ID NO:401)

reverse PCR primer
5'-CCCTGCAGGTCATTGGCAGCTAGG-3'.    (SEQ ID NO:402)
```

Additionally, a synthetic oligonucleotide hybridization probe was constructed from the DNA39626 consensus sequence which had the following nucleotide sequence:

```
hybridization probe                 (SEQ ID NO:403)
5'-AGGCACTGCCTGATGACACCTTCCGCGACCTGGGCAACCTCACAC-
3'.
```

In order to screen several libraries for a source of a full-length clone, DNA from the libraries was screened by PCR amplification with the PCR primer pair identified above. A positive library was then used to isolate clones encoding the PRO526 gene using the probe oligonucleotide and one of the PCR primers. RNA for construction of the cDNA libraries was isolated from human fetal liver tissue (LIB228).

DNA sequencing of the clones isolated as described above gave the full-length DNA sequence for PRO526 [herein designated as UNQ330 (DNA44184-1319)] (SEQ ID NO:399) and the derived protein sequence for PRO526.

The entire nucleotide sequence of UNQ330 (DNA44184-1319) is shown in FIG. 160 (SEQ ID NO:399). Clone UNQ330 (DNA44184-1319) contains a single open reading frame with an apparent translational initiation site at nucleotide positions 514–516 and ending at the stop codon at nucleotide positions 1933–1935 (FIG. 160). The predicted polypeptide precursor is 473 amino acids long (FIG. 161). The full-length PRO526 protein shown in FIG. 161 has an estimated molecular weight of about 50,708 daltons and a pI of about 9.28. Clone UNQ330 (DNA44184-1319) has been deposited with the ATCC on Mar. 26, 1998. It is understood that the clone contains the actual sequence, whereas the sequences presented herein are representative based on current sequencing techniques.

Analysis of the amino acid sequence of the full-length PRO526 polypeptide suggests that portions of it possess significant homology to the leucine repeat rich proteins including ALS, SLIT, carboxypeptidase and platelet glycoprotein V thereby indicating that PRO526 is a novel protein which is involved in protein-protein interactions.

Still analyzing SEQ ID NO:400, the signal peptide sequence is at about amino acids 1–26. A leucine zipper pattern is at about amino acids 135–156. A glycosaminoglycan attachment is at about amino acids 436–439. N-glycosylation sites are at about amino acids 82–85, 179–182, 237–240 and 423–426. A von Willebrand factor (VWF) type C domain(s) is found at about amino acids 411–425. The skilled artisan can understand which nucleotides correspond to these amino acids based on the sequences provided herein.

Example 64

Isolation of cDNA Clones Encoding Human PRO531

An ECD database was searched and an expressed sequence tag (EST) from LIFESEQ™, Incyte Pharmaceuticals, Palo Alto, Calif. was identified which showed homology to protocadherin 3. Based on this sequence, a search was performed using the computer program BLAST or BLAST2 (Altshul et al., *Methods in Enzymology* 266:460–480 (1996)) as a comparison of the ECD protein sequences to a 6 frame translation of the EST sequence. Those comparisons resulting in a BLAST score of 70 (or in some cases 90) or greater that did not encode known proteins were clustered and assembled into consensus DNA sequences with the program "phrap" (Phil Green, University of Washington, Seattle, Wash.).

A consensus DNA sequence was assembled relative to other EST sequences using phrap. Based on the consensus sequence obtained, oligonucleotides were synthesized: 1) to identify by PCR a cDNA library that contained the sequence of interest, and 2) for use as probes to isolate a clone of the full-length coding sequence for PRO531.

A pair of PCR primers (forward and reverse) were synthesized:

```
forward PCR primer
5'-CTGAGAACGCGCCTGAAACTGTG-3';    (SEQ ID NO:406)
```

```
reverse PCR primer
5'-AGCGTTGTCATTGACATCGGCG-3'.          (SEQ ID NO:407)
```

Additionally, a synthetic oligonucleotide hybridization probe was constructed from the consensus DNA sequence which had the following nucleotide sequence:

```
hybridization probe                    (SEQ ID NO:408)
5'-TTAGTTGCTCCATTCAGGAGGATCTACCCTTCCTCCTGAAATCCGCGG
AA-3'.
```

In order to screen several libraries for a source of a full-length clone, DNA from the libraries was screened by PCR amplification with the PCR primer pair identified above. A positive library was then used to isolate clones encoding the PRO531 gene using the probe oligonucleotide and one of the PCR primers. RNA for construction of the cDNA libraries was isolated from human fetal brain tissue (LIB153). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

DNA sequencing of the clones isolated as described above gave the full-length DNA sequence for PRO531 [herein designated as UNQ332 (DNA48314-1320)] (SEQ ID NO:404) and the derived protein sequence for PRO531.

The entire representative nucleotide sequence of UNQ332 (DNA48314-1320) is shown in FIG. 162 (SEQ ID NO:404). It is understood that the actual sequence is that within the clone deposited with the ATCC as DNA48314-1320. Clone UNQ332 (DNA48314-1320) contains a single open reading frame with an apparent translational initiation site at nucleotide positions 171–173 and ending at the stop codon at nucleotide positions 2565–2567 (FIG. 162). The predicted polypeptide precursor is 789 amino acids long (FIG. 163). The full-length PRO531 protein shown in FIG. 163 has an estimated molecular weight of about 87,552 daltons and a pI of about 4.84. Clone UNQ332 (DNA48314-1320) has been deposited with the ATCC on Mar. 26, 1998.

Analysis of the amino acid sequence of the full-length PRO531 polypeptide suggests that portions of it possess significant homology to protocadherin 3. Moreover, PRO531 is found in the brain, like other protocadherins, thereby indicating that PRO531 is a novel member of the cadherin superfamily.

Still analyzing the amino acid sequence of SEQ ID NO:405, the cadherin extracellular repeated domain signature is found at about amino acids 122–132, 231–241, 336–346, 439–449 and 549–559 of SEQ ID NO:405. An ATP/GTP-binding site motif A (P-loop) is found at about amino acids 285–292 of SEQ ID NO:405. N-glycosylation sites are found at least at about amino acids 567–570, 786–790, 418–421 and 336–339 of SEQ ID NO:405. The signal peptide is at about amino acids 1–26, and the transmembrane domain is at about amino acids 685–712 of SEQ ID NO:405.

Example 65

Isolation of cDNA Clones Encoding Human PRO534

A consensus sequence was obtained relative to a variety of EST sequences as described in Example 1 above, wherein the consensus sequence obtained is herein designated DNA43038. Based on the 43048 consensus sequence, oligonucleotides were synthesized: 1) to identify by PCR a cDNA library that contained the sequence of interest, and 2) for use as probes to isolate a clone of the full-length coding sequence for PRO534.

A pair of PCR primers (forward and reverse) were synthesized:

```
forward PCR primer
5'-CACAGAGCCAGAAGTGGCGGAATC-3';       (SEQ ID NO:411)

reverse PCR primer
5'-CCACATGTTCCTGCTCTTGTCCTGG-3'.      (SEQ ID NO:412)
```

Additionally, a synthetic oligonucleotide hybridization probe was constructed from the consensus DNA43038 sequence which had the following nucleotide sequence:

```
hybridization probe                    (SEQ ID NO:413)
5'-CGGTAGTGACTGTACTCTAGTCCTGTTTTACACCCCGTGGTGCCG-
3'.
```

In order to screen several libraries for a source of a full-length clone, DNA from the libraries was screened by PCR amplification with the PCR primer pair identified above. A positive library was then used to isolate clones encoding the PRO534 gene using the probe oligonucleotide and one of the PCR primers. RNA for construction of the cDNA libraries was isolated from human fetal lung tissue (LIB26).

DNA sequencing of the clones isolated as described above gave the full-length DNA sequence for PRO534 [herein designated as UNQ335 (DNA48333-1321)] (SEQ ID NO:409) and the derived protein sequence for PRO534.

The entire nucleotide sequence of UNQ335 (DNA48333-1321) is shown in FIG. 164 (SEQ ID NO:409). Clone UNQ335 (DNA48333-1321) contains a single open reading frame with an apparent translational initiation site at nucleotide positions 87–89 and ending at the stop codon at nucleotide positions 1167–1169 (FIG. 164). The predicted polypeptide precursor is 360 amino acids long (FIG. 165). The full-length PRO534 protein shown in FIG. 165 has an estimated molecular weight of about 39,885 daltons and a pI of about 4.79. Clone UNQ335 (DNA48333-1321) has been deposited with ATCC on Mar. 26, 1998. It is understood that the deposited clone contains the actual sequence, and that the sequences provided herein are representative based on current sequencing techniques.

Analysis of the amino acid sequence of the full-length PRO534 polypeptide suggests that portions of it possess significant sequence identity with the protein disulfide isomerase, thereby indicating that PRO534 may be a novel disulfide isomerase.

Still analyzing the amino acid sequence of PRO534, the signal peptides is at about amino acids 1–25 of SEQ ID NO:410. The transmembrane domain is at about amino acids 321–340 of SEQ ID NO:410. The disulfide isomerase corresponding region is at amino acids 212–302 of SEQ ID NO:410. The thioredoxin domain is at amino acids 211–227 of SEQ ID NO:410. N-glycosylation sites are at: 165–168, 181–184, 187–190, 194–197, 206–209, 278–281, and 293–296 of SEQ ID NO:410. The corresponding nucleotides can routinely be determined from the sequences provided herein. PRO534 has a transmembrane domain rather than an ER retention peptide like other protein disulfide isomerases. Additionally, PRO534 may have an intron at the 5 prime end.

Example 66

Isolation of cDNA Clones Encoding Human PRO697

A consensus sequence was obtained relative to a variety of EST sequences as described in Example 1 above, wherein the consensus sequence obtained is herein designated DNA43052. Based on this consensus sequence, oligonucleotides were synthesized: 1) to identify by PCR a cDNA library that contained the sequence of interest, and 2) for use as probes to isolate a clone of the full-length coding sequence for PRO697.

A pair of PCR primers (forward and reverse) were synthesized:

```
forward PCR primer
5'-CCTGGCTCGCTGCTGCTGCTC-3';        (SEQ ID NO:416)

reverse PCR primer
5'-CCTCACAGGTGCACTGCAAGCTGTC-3'.    (SEQ ID NO:417)
```

Additionally, a synthetic oligonucleotide hybridization probe was constructed from the DNA43052 consensus sequence which had the following nucleotide sequence:

```
hybridization probe                  (SEQ ID NO:418)
5'-CTCTTCCTCTTTGGCCAGCCCGACTTCTCCTACAAGCGCAGAATTGC-
3'.
```

In order to screen several libraries for a source of a full-length clone, DNA from the libraries was screened by PCR amplification with the PCR primer pair identified above. A positive library was then used to isolate clones encoding the PRO697 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO697 [herein designated as UNQ361 (DNA50920-1325)] (SEQ ID NO:414) and the derived protein sequence for PRO697.

The entire nucleotide sequence of UNQ361 (DNA50920-1325) is shown in FIG. 166 (SEQ ID NO:414). Clone UNQ361 (DNA50920-1325) contains a single open reading frame with an apparent translational initiation site at nucleotide positions 44–46 and ending at the stop codon at nucleotide positions 929–931 (FIG. 166). The predicted polypeptide precursor is 295 amino acids long (FIG. 167). The full-length PRO697 protein shown in FIG. 167 has an estimated molecular weight of about 33,518 daltons and a pI of about 7.74. Clone UNQ361 (DNA50920-1325) was deposited with the ATCC on Mar. 26, 1998. It is understood that the deposited clone contains the actual sequence, and that the sequences provided herein are representative based on current sequencing techniques.

Analysis of the amino acid sequence of the full-length PRO697 polypeptide suggests that portions of it possess significant sequence identity with sFRPs, thereby indicating that PRO697 may be a novel sFRP family member.

Still analyzing the amino acid sequence of PRO697, the signal peptides is at about amino acids 1–20 of SEQ ID NO:415. The cystein rich domain, having identity with the frizzled N-terminus, is at about amino acids 6–153 of SEQ ID NO:415. The corresponding nucleotides can routinely be determined from the sequences provided herein.

Example 67

Isolation of cDNA Clones Encoding Human PRO717

A consensus sequence was obtained relative to a variety of EST sequences as described in Example 1 above, wherein the consensus sequence obtained is herein designated DNA42829. Based on the DNA42829 consensus sequence, oligonucleotides were synthesized: 1) to identify by PCR a cDNA library that contained the sequence of interest, and 2) for use as probes to isolate a clone of the full-length coding sequence for PRO717.

A pair of PCR primers (forward and reverse) were synthesized:

```
forward PCR primer
5'-AGCTTCTCAGCCCTCCTGGAGCAG-3';     (SEQ ID NO:421)

reverse PCR primer
5'-CGGGTCAATAAACCTGGACGCTTGG-3'.    (SEQ ID NO:422)
```

Additionally, a synthetic oligonucleotide hybridization probe was constructed from the DNA42829 consensus sequence which had the following nucleotide sequence:

```
hybridization probe                  (SEQ ID NO:423)
5'-TATGTGGACCGGACCAAGCACTTCACTGAGGCCACCAAGATTG-3'.
```

In order to screen several libraries for a source of a full-length clone, DNA from the libraries was screened by PCR amplification with the PCR primer pair identified above. A positive library was then used to isolate clones encoding the PRO717 gene using the probe oligonucleotide and one of the PCR primers. RNA for construction of the cDNA libraries was isolated from human fetal liver tissue (LIB229).

DNA sequencing of the clones isolated as described above gave the full-length DNA sequence for PRO717 [herein designated as UNQ385 (DNA50988-1326)] (SEQ ID NO:419) and the derived protein sequence for PRO717.

The entire nucleotide sequence of UNQ385 (DNA50988-1326) is shown in FIG. 168 (SEQ ID NO:419). Clone UNQ385 (DNA50988-1326) contains a single open reading frame with an apparent translational initiation site at nucleotide positions 17–19 and ending at the stop codon at nucleotide positions 1697–1699 (FIG. 168). The predicted polypeptide precursor is 560 amino acids long (FIG. 169). The full-length PRO717 protein shown in FIG. 169 has an estimated molecular weight of about 58,427 daltons and a pI of about 6.86. Clone UNQ385 (DNA50988-1326) has been deposited with the ATCC on Apr. 28, 1998. Regarding the sequence, it is understood that the deposited clone contains the correct sequence, and the sequences provided herein are based on known sequencing techniques.

Analysis of the amino acid sequence of the full-length PRO717 polypeptide suggests that PRO717 may be a novel 12 transmembrane receptor. The reverse complement strand of DNA50988 has a stretch that matches identically with human regulatory myosin light strand.

Still analyzing the amino acid sequence of SEQ ID NO:420, transmembrane domains are at about amino acids 30–50, 61–79, 98–112, 126–146, 169–182, 201–215, 248–268, 280–300, 318–337, 341–357, 375–387, and 420–441 of SEQ ID NO:420. N-glycosylation sites are at about amino acids 40–43 and 43–46 of SEQ ID NO:420. A glycosaminoglycan attachment site is at about amino acids 468–471 of SEQ ID NO:420. The corresponding nucleotides can be routinely determined given the sequences provided herein.

Example 68

Isolation of cDNA Clones Encoding Human PRO731

A database was used to search expressed sequence tag (EST) databases. The EST database used herein was the proprietary EST DNA database LIFESEQ™, of Incyte Pharmaceuticals, Palo Alto, Calif. Incyte clone 2581326 was herein identified and termed DNA42801. Based on the DNA42801 sequence, oligonucleotides were synthesized: 1) to identify by PCR a cDNA library that contained the sequence of interest, and 2) for use as probes to isolate a clone of the full-length coding sequence for PRO731.

A pair of PCR primers (forward and reverse) were synthesized:

```
forward PCR primer
5'-GTAAGCACATGCCTCCAGAGGTGC-3';   (SEQ ID NO:426)

reverse PCR primer
5'-GTGACGTGGATGCTTGGGATGTTG-3'.   (SEQ ID NO:427)
```

Additionally, a synthetic oligonucleotide hybridization probe was constructed from the DNA42801 sequence which had the following nucleotide sequence:

```
hybridization probe                  (SEQ ID NO:428)
5'-TGGACACCTTCAGTATTGATGCCAAGACAGGCCAGGTCATTCTGCGTC
GA-3'.
```

In order to screen several libraries for a source of a full-length clone, DNA from the libraries was screened by PCR amplification with the PCR primer pair identified above. A positive library was then used to isolate clones encoding the PRO731 gene using the probe oligonucleotide and one of the PCR primers. RNA for construction of the cDNA libraries was isolated from human bone marrow tissue (LIB255). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., Science, 253:1278–1280 (1991)) in the unique XhoI and NotI sites.

DNA sequencing of the clones isolated as described above gave the full-length DNA sequence for PRO731 [herein designated as UNQ395 (DNA48331-1329)] (SEQ ID NO:424) and the derived protein sequence for PRO731.

The entire nucleotide sequence of UNQ395 (DNA48331-1329) is shown in FIG. 170 (SEQ ID NO:424). Clone UNQ395 (DNA48331-1329) contains a single open reading frame with an apparent translational initiation site at nucleotide positions 329–331 and ending at the stop codon at nucleotide positions 3881–3883 (FIG. 170). The predicted polypeptide precursor is 1184 amino acids long (FIG. 171). The full-length PRO731 protein shown in FIG. 171 has an estimated molecular weight of about 129,022 daltons and a pI of about 5.2. Clone UNQ395 (DNA48331-1329) was deposited with the ATCC on Mar. 31, 1998. Regarding the sequence, it is understood that the deposited clone contains the correct sequence, and the sequences provided herein are based on known sequencing techniques.

Analysis of the amino acid sequence of the full-length PRO731 polypeptide suggests that portions of it possess significant identity and similarity to members of the protocadherin family, thereby indicating that PRO731 may be a novel protocadherin.

Still analyzing the amino acid sequence of SEQ ID NO:425, the putative signal peptide is at about amino acids 1–13 of SEQ ID NO:425. The transmembrane domain is at amino acids 719–739 of SEQ ID NO:425. The N-glycosylation of SEQ ID NO:425 are as follows: 415–418, 582–586, 659–662, 662–665, and 857–860. The cadherin extracellular repeated domain signatures are at about amino acids (of SEQ ID NO:425): 123–133, 232–242, 340–350, 448–458, and 553–563. The corresponding nucleotides can be routinely determined given the sequences provided herein.

Example 69

Isolation of cDNA Clones Encoding Human PRO218

A consensus sequence was obtained relative to a variety of EST sequences as described in Example 1 above, wherein the consensus sequence obtained is herein designated DNA17411. Two proprietary Genentech EST sequences were employed in the consensus assembly and are shown in FIGS. 174 and 175. Based on the DNA17411 consensus sequence, oligonucleotides were synthesized: 1) to identify by PCR a cDNA library that contained the sequence of interest, and 2) for use as probes to isolate a clone of the full-length coding sequence for PRO218.

A pair of PCR primers (forward and reverse) were synthesized:

```
forward PCR primer
5'-AAGTGGAGCCGGAGCCTTCC-3';     (SEQ ID NO:433)

reverse PCR primer
5'-TCGTTGTTTATGCAGTAGTCGG-3'.   (SEQ ID NO:434)
```

Additionally, a synthetic oligonucleotide hybridization probe was constructed from the consensus DNA17411 sequence which had the following nucleotide sequence:

```
hybridization probe                  (SEQ ID NO:435)
5'-ATTGTTTAAAGACTATGAGATACGTCAGTATGTTGTACAGG-3'.
```

In order to screen several libraries for a source of a full-length clone, DNA from the libraries was screened by PCR amplification with the PCR primer pair identified above. A positive library was then used to isolate clones encoding the PRO218 gene using the probe oligonucleotide and one of the PCR primers. RNA for construction of the cDNA libraries was isolated from human fetal kidney tissue (LIB28).

DNA sequencing of the clones isolated as described above gave the full-length DNA sequence for PRO218 [herein designated as UNQ192 (DNA30867-1335)] (SEQ ID NO:429) and the derived protein sequence for PRO218.

The entire nucleotide sequence of UNQ192 (DNA30867-1335) is shown in FIG. 172 (SEQ ID NO:429). Clone UNQ192 (DNA30867-1335) contains a single open reading frame with an apparent translational initiation site at nucleotide positions 150–152 and ending at the stop codon at nucleotide positions 1515–1517 (FIG. 172). The predicted polypeptide precursor is 455 amino acids long (FIG. 173). The full-length PRO218 protein shown in FIG. 173 has an estimated molecular weight of about 52,917 daltons and a pI of about 9.5. Clone UNQ192 (DNA30867-1335) has been deposited with the ATCC on Apr. 28, 1998. Regarding the sequence, it is understood that the deposited clone contains the correct sequence, and the sequences provided herein are based on known sequencing techniques.

Analysis of the amino acid sequence of the full-length PRO218 polypeptide suggests that PRO218 may be a novel transmembrane protein.

Still analyzing the amino acid sequence of SEQ ID NO:430, the putative signal peptide is at about amino acids 1 through 23 of SEQ ID NO:430. Transmembrane domains are potentially at about amino acids 37–55, 81–102, 150–168, 288–311, 338–356, 375–398, and 425–444 of SEQ ID NO:430. N-glycosylation sites are at about amino acids 67, 180, and 243 of SEQ ID NO:430. Eukaryotic cobalamin-binding protein is at about amino acids 151–160 of SEQ ID NO:430. The corresponding nucleotides can be routinely determined given the sequences provided herein.

Example 70

Isolation of cDNA Clones Encoding Human PRO768

A consensus sequence was obtained relative to a variety of EST sequences as described in Example 1 above, wherein the consensus sequence obtained is herein designated DNA43448. Based on the DNA43448 consensus sequence, oligonucleotides were synthesized: 1) to identify by PCR a cDNA library that contained the sequence of interest, and 2) for use as probes to isolate a clone of the full-length coding sequence for PRO768.

A pair of PCR primers (forward and reverse) were synthesized:

```
forward PCR primer
5'-GGCTGACACCGCAGTGCTCTTCAG-3';    (SEQ ID NO:438)

reverse PCR primer
5'-GCTGCTGGGGACTGCAATGTAGCTG-3'.   (SEQ ID NO:439)
```

Additionally, a synthetic oligonucleotide hybridization probe was constructed from the DNA43448 consensus sequence which had the following nucleotide sequence:

```
hybridization probe                 (SEQ ID NO:440)
```

```
                                    -continued
5'-CATCCTCCATGTCTCCCATGAGGTCTCTATTGCTCCACGAAGCATC-3'.
```

In order to screen several libraries for a source of a full-length clone, DNA from the libraries was screened by PCR amplification with the PCR primer pair identified above. A positive library was then used to isolate clones encoding the PRO768 gene using the probe oligonucleotide and one of the PCR primers. RNA for construction of the cDNA libraries was isolated from human bone marrow tissue (LIB255).

DNA sequencing of the clones isolated as described above gave the full-length DNA sequence for PRO768 [herein designated as UNQ406 (DNA55737-1345)] (SEQ ID NO:436) and the derived protein sequence for PRO768.

The entire nucleotide sequence of UNQ406 (DNA55737-1345) is shown in FIG. 176 (SEQ ID NO:436). Clone UNQ406 (DNA55737-1345) contains a single open reading frame with an apparent translational initiation site at nucleotide positions 20–22 and ending at the stop codon at nucleotide positions 3443–3445 (FIG. 176). The predicted polypeptide precursor is 1141 amino acids long (FIG. 177). The full-length PRO768 protein shown in FIG. 177 has an estimated molecular weight of about 124,671 daltons and a pI of about 5.82. Clone UNQ406 (DNA55737-1345) has been deposited with the ATCC on Apr. 6, 1998. Regarding the sequence, it is understood that the deposited clone contains the correct sequence, and the sequences provided herein are based on known sequencing techniques.

Analysis of the amino acid sequence of the full-length PRO768 polypeptide suggests that portions of it possess significant sequence identity and similarity with integrin 7.

Still analyzing the amino acid sequence of SEQ ID NO:437, the putative signal peptide is at about amino acids 1–33 of SEQ ID NO:437. The transmembrane domain is at amino acids 1039–1064 of SEQ ID NO:437. N-glycosylation sites are at amino acids: 86–89, 746–749, 949–952, 985–988 and 1005–1008 of SEQ ID NO:437. Integrin alpha chain protein domains are identified at about amino acids: 1064–1071, 384–409, 1041–1071, 317–346, 443–465, 385–407, 215–224, 634–647, 85–99, 322–346, 470–479, 442–466, 379–408 and 1031–1047 of SEQ ID NO:437. The corresponding nucleotides can be routinely determined given the sequences provided herein.

Example 71

Isolation of cDNA Clones Encoding Human PRO771

A consensus sequence was obtained relative to a variety of EST sequences as described in Example 1 above, wherein the consensus sequence obtained is herein designated DNA43330. Based on the DNA43330 sequence, oligonucleotides were synthesized: 1) to identify by PCR a cDNA library that contained the sequence of interest, and 2) for use as probes to isolate a clone of the full-length coding sequence for PRO771.

A pair of PCR primers (forward and reverse) were synthesized:

```
forward PCR primer  5'-CAGCAATATTCAGAAGCGGCAAGGG-3';      (SEQ ID NO:443)

reverse PCR primer  5'-CATCATGGTCATCACCACCATCATCATC-3'.   (SEQ ID NO:444)
```

Additionally, a synthetic oligonucleotide hybridization probe was constructed from the DNA43330 consensus sequence which had the following nucleotide sequence:

```
hybridization probe                              (SEQ ID NO:445)
5'-GGTTACTACAAGCCAACACAATGTCATGGCAGTGTTGGACAGTGCTG
G-3'.
```

In order to screen several libraries for a source of a full-length clone, DNA from the libraries was screened by PCR amplification with the PCR primer pair identified above. A positive library was then used to isolate clones encoding the PRO771 gene using the probe oligonucleotide and one of the PCR primers. RNA for construction of the cDNA libraries was isolated from human fetal kidney tissue (LIB28).

DNA sequencing of the clones isolated as described above gave the full-length DNA sequence for PRO771 [herein designated as UNQ409 (DNA49829-1346)] (SEQ ID NO:441) and the derived protein sequence for PRO771.

The entire nucleotide sequence of UNQ409 (DNA49829-1346) is shown in FIG. 178 (SEQ ID NO:441). Clone UNQ409 (DNA49829-1346) contains a single open reading frame with an apparent translational initiation site at nucleotide positions 134–136 and ending at the stop codon at nucleotide positions 1442–1444 (FIG. 178). The predicted polypeptide precursor is 436 amino acids long (FIG. 179). The full-length PRO771 protein shown in FIG. 179 has an estimated molecular weight of about 49,429 daltons and a pI of about 4.8. Clone UNQ409 (DNA49829-1346) has been deposited with the ATCC on Apr. 7, 1998. Regarding the sequence, it is understood that the deposited clone contains the correct sequence, and the sequences provided herein are based on known sequencing techniques.

Analysis of the amino acid sequence of the full-length PRO771 polypeptide suggests that portions of it possess significant homology to the testican protein, thereby indicating that PRO771 may be a novel testican homologue.

Still analyzing the amino acid sequence of SEQ ID NO:442, the putative signal peptide, leucine zipper pattern, N-myristoylation sites, and thyroglobulin type-1 repeats are also shown in FIG. 179. The corresponding nucleotides can be routinely determined given the sequences provided herein.

Example 72

Isolation of cDNA Clones Encoding Human PRO733

A consensus sequence was obtained relative to a variety of EST sequences as described in Example 1 above, wherein the consensus sequence obtained is herein designated DNA45600. Based on the DNA45600 consensus sequence, oligonucleotides were synthesized: 1) to identify by PCR a cDNA library that contained the sequence of interest, and 2) for use as probes to isolate a clone of the full-length coding sequence for PRO733.

A pair of PCR primers (forward and reverse) were synthesized:

```
forward PCR primer
5'-CCCAGCAGGGATGGGCGACAAGA-3';    (SEQ ID NO:448)

reverse PCR primer
5'-GTCTTCCAGTTTCATATCCAATA-3'.    (SEQ ID NO:449)
```

Additionally, a synthetic oligonucleotide hybridization probe was constructed from the DNA45600 consensus sequence which had the following nucleotide sequence:

```
hybridization probe                              (SEQ ID NO:450)
5'-CCAGAAGGAGCACGGGGAAGGGCAGCCAGATCTTGTCGCCCAT-3'.
```

In order to screen several libraries for a source of a full-length clone, DNA from the libraries was screened by PCR amplification with the PCR primer pair identified above. A positive library was then used to isolate clones encoding the PRO733 gene using the probe oligonucleotide and one of the PCR primers. RNA for construction of the cDNA libraries was isolated from human bone marrow tissue (LIB255).

DNA sequencing of the clones isolated as described above gave the full-length DNA sequence for PRO733 [herein designated as UNQ411 (DNA52196-1348)] (SEQ ID NO:446) and the derived protein sequence for PRO733.

The entire nucleotide sequence of UNQ411 (DNA52196-1348) is shown in FIG. 180 (SEQ ID NO:446). Clone UNQ411 (DNA52196-1348) contains a single open reading frame with an apparent translational initiation site at nucleotide positions 106–108 and ending at the stop codon at nucleotide positions 793–795 (FIG. 180). The predicted polypeptide precursor is 229 amino acids long (FIG. 181). The full-length PRO733 protein shown in FIG. 181 has an estimated molecular weight of about 26,017 daltons and a pI of about 4.73. Clone UNQ411 (DNA52196-1348) has been deposited with the ATCC on Apr. 7, 1998. Regarding the sequence, it is understood that the deposited clone contains the correct sequence, and the sequences provided herein are based on known sequencing techniques.

Analysis of the amino acid sequence of the full-length PRO733 polypeptide suggests that portions of it possess significant sequence identity and similarity to the T1/ST2 receptor binding protein precursor and therefore may have a similar function in cell signaling. If it is a cytokine, it may be useful in the treatment of inflammation and cancer.

Still analyzing the amino acid sequence of SEQ ID NO:447, the putative signal peptide, transmembrane domain, N-myristoylation site, and tyrosine kinase site are also shown in FIG. 181. The corresponding nucleotides can be routinely determined given the sequences provided herein.

Example 73

Isolation of cDNA Clones Encoding Human PRO162

An expressed sequence tag (EST) DNA database (Merck/Washington University) was searched and an EST AA397543 was identified which showed homology to human pancreatitis-associated protein. The EST AA397543 cole was purchased and its insert obtained and sequenced and the sequence obtained is shown in FIG. 182 (SEQ ID NO:451).

The entire nucleotide sequence of PRO162 is shown in FIG. 182 (SEQ ID NO:451). DNA sequencing of the clone gave the full-length DNA sequence for PRO162 [herein designated as UNQ429 (DNA56965-1356)] (SEQ ID NO:451) and the derived protein sequence for PRO162. Clone UNQ429 (DNA56965-1356) contains a single open reading frame with an apparent translational initiation site at nucleotide positions 86–88 and ending at the stop codon at nucleotide positions 611–613 (FIG. 182). The predicted polypeptide precursor is 175 amino acids long (FIG. 183). The full-length PRO162 protein shown in FIG. 183 has an estimated molecular weight of about 19,330 daltons and a pI of about 7.25. Clone UNQ429 (DNA56965-1356) has been deposited with the ATCC. Regarding the sequence, it is understood that the deposited clone contains the correct sequence, and the sequences provided herein are based on known sequencing techniques.

Analysis of the amino acid sequence of the full-length PRO162 polypeptide suggests that portions of it possess significant homology to the human pancreatitis-associated protein, thereby indicating that PRO162 may be a novel pancreatitis-associated protein.

Still analyzing the amino acid sequence of SEQ ID NO:452, the putative signal peptide is at about amino acids 1–26 of SEQ ID NO:452. A C-type lectin domain signature is at about amino acids 146–171 of SEQ ID NO:452. The corresponding nucleotides can be routinely determined given the sequences provided herein.

Example 74

Isolation of cDNA Clones Encoding Human PRO788

A consensus DNA sequence (designated herein as DNA49308) was assembled relative to other EST sequences using phrap as described in Example 1 above. Based upon an observed homology between the DNA49308 consensus sequence and the Incyte EST clo0ne no. 2777282, the Incyte EST clone no. 2777282 was purchased and its insert obtained and sequenced, which gave the full-length DNA sequence for PRO788 [herein designated as UNQ430 (DNA56405-1357)] (SEQ ID NO:453) and the derived protein sequence for PRO788.

Clone UNQ430 (DNA56405-1357) contains a single open reading frame with an apparent translational initiation site at nucleotide positions 84–86 and ending at the stop codon at nucleotide positions 459–461 (FIG. 184). The predicted polypeptide precursor is 125 amino acids long (FIG. 185). The full-length PRO788 protein shown in FIG. 185 has an estimated molecular weight of about 13,115 daltons and a pI of about 5.90. Clone UNQ430 (DNA56405-1357) has been deposited with the ATCC. Regarding the sequence, it is understood that the deposited clone contains the correct sequence, and the sequences provided herein are based on known sequencing techniques.

Still analyzing FIG. 185, a signal peptide is shown at about amino acids 1–17 of SEQ ID NO:454. An N-glycosylation site is at about amino acids 46–49 of SEQ ID NO:454.

Example 75

Isolation of cDNA Clones Encoding Human PRO1008

A consensus DNA sequence was assembled relative to other EST sequences using phrap as described in Example 1 above. This consensus sequence is herein designated as DNA49804. An EST proprietary to Genentech was employed in the consensus assembly and is herein designated as DNA16508 (FIG. 188; SEQ ID NO:457). Based upon an observed homology between the DNA49804 sequence and Merck EST clone no. AA143670, the Merck EST clone no. AA143670 was purchased and its insert obtained and sequenced. That sequence is shown herein in FIG. 186 (SEQ ID NO:455).

Sequencing gave the full length sequence for PRO1008 [herein designated as UNQ492 (DNA57530-1375)] (SEQ ID NO:455) and the derived protein sequence for PRO1008 were identified.

The entire nucleotide sequence of UNQ492 (DNA57530-1375) is shown in FIG. 186 (SEQ ID NO:455). Clone UNQ492 (DNA57530-1375) contains a single open reading frame with an apparent translational initiation site at nucleotide positions 138–140 and ending at the stop codon at nucleotide positions 936–938 (FIG. 186). The predicted polypeptide precursor is 266 amino acids long (FIG. 187). The full-length PRO1008 protein shown in FIG. 187 has an estimated molecular weight of about 28,672 daltons and a pI of about 8.85. Clone UNQ492 (DNA57530-1375) has been deposited with the ATCC on May 20, 1998. Regarding the sequence, it is understood that the deposited clone contains the correct sequence, and the sequences provided herein are based on known sequencing techniques.

Analysis of the amino acid sequence of the full-length PRO1008 polypeptide suggests that portions of it possess significant sequence identity and/or similarity with mdkk-1, thereby indicating that PRO1008 may be a novel member of this family and have head inducing activity.

Still analyzing the amino acid sequence of SEQ ID NO:456, the putative signal peptide is at about amino acids 1–23 of SEQ ID NO:456. The N-glycosylation site is at about amino acids 256–259 of SEQ ID NO:456, and the fungal zn-(2)-cys(6) binuclear cluster domain is at about amino acids 110–126 of SEQ ID NO:456. The corresponding nucleotides can of all the amino acids can be routinely determined given the sequences provided herein.

Example 76

Isolation of cDNA Clones Encoding Human PRO1012

A consensus DNA sequence was assembled relative to other EST sequences using phrap as described in Example 1 above, wherein the consensus sequence is herein designated DNA49313. Based on the DNA49313 consensus sequence, oligonucleotides were synthesized: 1) to identify by PCR a cDNA library that contained the sequence of interest, and 2) for use as probes to isolate a clone of the full-length coding sequence for PRO1012.

A pair of PCR primers (forward and reverse) were synthesized:

```
forward PCR primer
5'-ACTCCCCAGGCTGTTCACACTGCC-3';    (SEQ ID NO:460)

reverse PCR primer
5'-GATCAGCCAGCCAATACCAGCAGC-3'.    (SEQ ID NO:461)
```

Additionally, a synthetic oligonucleotide hybridization probe was constructed from the DNA49313 consensus sequence which had the following nucleotide sequence:

```
hybridization probe                         (SEQ ID NO:462)
5'-GTGGTGATGATAGAATGCTTTGCCGAATGAAAGGAGTCAACAGCTATC
CC-3'.
```

In order to screen several libraries for a source of a full-length clone, DNA from the libraries was screened by PCR amplification with the PCR primer pair identified above. A positive library was then used to isolate clones encoding the PRO1012 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO1012 [herein designated as UNQ495 (DNA56439-1376)] (SEQ ID NO:458) and the derived protein sequence for PRO1012.

The entire nucleotide sequence of UNQ495 (DNA56439-1376) is shown in FIG. 189 (SEQ ID NO:458). Clone UNQ495 (DNA56439-1376) contains a single open reading frame with an apparent translational initiation site at nucleotide positions 404–406 and ending at the stop codon at nucleotide positions 2645–2647 (FIG. 189). The predicted polypeptide precursor is 747 amino acids long (FIG. 190). The full-length PRO1012 protein shown in FIG. 190 has an estimated molecular weight of about 86,127 daltons and a pI of about 7.46. Clone UNQ495 (DNA56439-1376) has been deposited with ATCC on May 14, 1998. Regarding the sequence, it is understood that the deposited clone contains the correct sequence, and the sequences provided herein are based on known sequencing techniques.

Analysis of the amino acid sequence of the full-length PRO1012 polypeptide suggests that portions of it possess sequence identity with disulfide isomerase thereby indicating that PRO1012 may be a novel disulfide isomerase related protein.

Still analyzing the amino acid sequence of SEQ ID NO:459, the cytochrome C family heme-binding site signature is at about amino acids 158–163 of SEQ ID NO:459. The Nt-DNAJ domain signature is at about amino acids 77–96 of SEQ ID NO:459. An N-glycosylation site is at about amino acids 484–487 of SEQ ID NO:459. The ER targeting sequence is at about amino acids 744–747 of SEQ ID NO:459. It is understood that the polypeptide and nucleic acids disclosed can be routinely formed with or without, these portions as desired, in alternative embodiments. For example, it may be desirable to produce PRO1012 without the ER targeting sequence. The corresponding nucleotides can be routinely determined given the sequences provided herein.

Example 77

Isolation of cDNA Clones Encoding Human PRO1014

A consensus DNA sequence was assembled relative to other EST sequences using phrap as described in Example 1 abobe, wherein the consensus sequence obtained is herein designated DNA49811. Based upon an observed homology between the DNA49811 sequence and Incyte EST clone no. 2612207, Incyte EST clone no. 2612207 was purchased and its insert was obtained and sequenced, wherein the sequence obtained is shown in FIG. 191 (SEQ ID NO:463).

DNA sequencing gave the full-length DNA sequence for PRO1014 [herein designated as UNQ497 (DNA56409-1377)] (SEQ ID NO:463) and the derived protein sequence for PRO1014.

The entire nucleotide sequence of UNQ497 (DNA56409-1377) is shown in FIG. 191 (SEQ ID NO:463). Clone UNQ497 (DNA56409-1377) contains a single open reading frame with an apparent translational initiation site at nucleotide positions 66–68 and ending at the stop codon at nucleotide positions 966–968 (FIG. 191). The predicted polypeptide precursor is 300 amino acids long (FIG. 192). The full-length PRO1014 protein shown in FIG. 192 has an estimated molecular weight of about 33,655 daltons and a pI of about 9.31. Clone UNQ497 (DNA56409-1377) has been deposited with the ATCC on May 20, 1998. Regarding the sequence, it is understood that the deposited clone contains the correct sequence, and the sequences provided herein are based on known sequencing techniques.

Analysis of the amino acid sequence of the full-length PRO1014 polypeptide suggests that portions of it possess sequence identity with reductase, thereby indicating that PRO1014 may be a novel member of the reductase family.

Still analyzing the amino acid sequence of SEQ ID NO:464, the putative signal peptide is at about amino acids 1–19 of SEQ ID NO:464. The cAMP and cGMP dependent protein kinase phosphorylation sites are at about amino acids 30–33 and 58–61 of SEQ ID NO:464. Short chain alcohol dehydrogenase family proteins are at about amino acids 165–202, 37–49, 112–122 and 210–219 of SEQ ID NO:464. The corresponding nucleotides of these domains and any other amino acids provided herein can be routinely determined given the sequences provided herein.

Example 78

Isolation of cDNA Clones Encoding Human PRO1017

A consensus DNA sequence was assembled relative to other EST sequences using phrap as described in Example 1 above, wherein that consensus DNA sequence is herein designated DNA53235. Based upon an observed homology between the DNA53235 consensus sequence and the Merck EST clone no. AA243086, the Merck EST clone no. AA243086 was purchased and its insert obtained and sequenced, wherein the sequence obtained is shown in FIG. 193 (SEQ ID NO:465). DNA sequencing gave the full-length DNA sequence for PRO1017 [herein designated as UNQ500 (DNA56112-1379)] (SEQ ID NO:465) and the derived protein sequence for PRO1017.

The entire nucleotide sequence of UNQ500 (DNA56112-1379) is shown in FIG. 193 (SEQ ID NO:465). Clone UNQ500 (DNA56112-1379) contains a single open reading frame with an apparent translational initiation site at nucleotide positions 128–130 and ending at the stop codon at nucleotide positions 1370–1372 (FIG. 193). The predicted polypeptide precursor is 414 amino acids long (FIG. 194). The full-length PRO1017 protein shown in FIG. 194 has an estimated molecular weight of about 48,414 daltons and a pI of about 9.54. Clone UNQ500 (DNA56112-1379) has been deposited with the ATCC. Regarding the sequence, it is understood that the deposited clone contains the correct sequence, and the sequences provided herein are based on known sequencing techniques.

Analysis of the amino acid sequence of the full-length PRO1017 polypeptide suggests that portions of it possess sequence identity with HNK-1 sulfotransferase, thereby indicating that PRO1017 may be a novel sulfotransferase.

Still analyzing the amino acid sequence of SEQ ID NO:466, the putative signal peptide is at about amino acids 1–31 of SEQ ID NO:466. N-glycosylation sites are at about amino acids 134–137, 209–212, 280–283 and 370–273 of SEQ ID NO:466. The TNFR/NGFR family cystein-rich region protein is at about amino acids 329–332 of SEQ ID NO:466. The corresponding nucleotides can be routinely determined given the sequences provided herein. The protein can be secreted.

Example 79

Isolation of cDNA Clones Encoding Human PRO474

A consensus DNA sequence was assembled relative to other EST sequences using phrap as described in Example 1 above, wherein the consensus sequence obtained is herein designated DNA49818. Based upon an observed homology between the DNA49818 consensus sequence and the Merck EST clone no. H77889, the Merck EST clone no. H77889 was purchased and its insert obtained and sequenced, wherein the sequence obtained is herein shown in FIG. 195 (SEQ ID NO:467). DNA sequencing gave the full-length DNA sequence for PRO474 [herein designated as UNQ502 (DNA56045-1380)] (SEQ ID NO:467) and the derived protein sequence for PRO474.

The entire nucleotide sequence of UNQ502 (DNA56045-1380) is shown in FIG. 195 (SEQ ID NO:467). Clone UNQ502 (DNA56045-1380) contains a single open reading frame with an apparent translational initiation site at nucleotide positions 106–108 and ending at the stop codon at nucleotide positions 916–918 (FIG. 195). The predicted polypeptide precursor is 270 amino acids long (FIG. 196). The full-length PRO474 protein shown in FIG. 196 has an estimated molecular weight of about 28,317 daltons and a pI of about 6.0. Clone UNQ502 (DNA56045-1380) has been deposited with the ATCC. Regarding the sequence, it is understood that the deposited clone contains the correct sequence, and the sequences provided herein are based on known sequencing techniques.

Still analyzing the amino acid sequence of SEQ ID NO:468, an N-glycosylation site is at about amino acids 138–141 of SEQ ID NO:468. Short-chain alcohol dehydrogenase family proteins are at about amino acids 10–22, 81–91, 134–171 and 176–185 of SEQ ID NO:468. The corresponding nucleotides can be routinely determined given the sequences provided herein.

Example 80

Isolation of cDNA Clones Encoding Human PRO1031

An initial consensus DNA sequence was assembled relative to other EST sequences using phrap as described in Example 1 above, wherein the consensus sequence obtained is herein designated as DNA47332. Based upon an observed homology between the DNA47332 sequence and the Merck EST clone no. W74558, Merck EST clone no. W74558 was purchased and its insert obtained and sequenced, wherein the sequence obtained is shown in FIG. 197 (SEQ ID NO:469). DNA sequencing gave the full-length DNA sequence for PRO1031 [herein designated as UNQ516 (DNA59294-1381)] (SEQ ID NO:469) and the derived protein sequence for PRO1031.

The entire nucleotide sequence of UNQ516 (DNA59294-1381) is shown in FIG. 197 (SEQ ID NO:469). Clone UNQ516 (DNA59294-1381) contains a single open reading frame with an apparent translational initiation site at nucleotide positions 42–44 and ending at the stop codon at nucleotide positions 582–584 (FIG. 197). The predicted polypeptide precursor is 180 amino acids long (FIG. 198). The full-length PRO1031 protein shown in FIG. 198 has an estimated molecular weight of about 20,437 daltons and a pI of about 9.58. Clone UNQ516 (DNA59294-1381) has been deposited with the ATCC. Regarding the sequence, it is understood that the deposited clone contains the correct sequence, and the sequences provided herein are based on known sequencing techniques.

Analysis of the amino acid sequence of the full-length PRO1031 polypeptide suggests that it is a novel cytokine.

Still analyzing the amino acid sequence of SEQ ID NO:470, the putative signal peptide is at about amino acids 1–20 of SEQ ID NO:470. An N-glycosylation site is at about amino acids 75–78 of SEQ ID NO:470. A region having sequence identity with IL-17 is at about amino acids 96–180. The corresponding nucleotides can be routinely determined given the sequences provided herein.

Example 81

Isolation of cDNA Clones Encoding Human PRO938

A consensus DNA sequence was assembled relative to other EST sequences using phrap as described in Example 1 above, wherein that consensus sequence is herein designated DNA49798. Based on the DNA49798 DNA consensus sequence, oligonucleotides were synthesized: 1) to identify by PCR a cDNA library that contained the sequence of interest, and 2) for use as probes to isolate a clone of the full-length coding sequence for PRO938.

A pair of PCR primers (forward and reverse) were synthesized:

```
forward PCR primer
5'-GTCCAGCCCATGACCGCCTCCAAC-3'    (SEQ ID NO:473)

reverse PCR primer
5'-CTCTCCTCATCCACACCAGCAGCC-3'    (SEQ ID NO:474)
```

Additionally, a synthetic oligonucleotide hybridization probe was constructed from the consensus DNA49798 sequence which had the following nucleotide sequence:

```
hybridization probe                         (SEQ ID NO:475)
5'-GTGGATGCTGAAATTTTACGCCCCATGGTGTCCATCCTGCCAGC-3'
```

In order to screen several libraries for a source of a full-length clone, DNA from the libraries was screened by PCR amplification with the PCR primer pair identified above. A positive library was then used to isolate clones encoding the PRO938 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO938 [herein designated as UNQ475 (DNA56433-1406)] (SEQ ID NO:471) and the derived protein sequence for PRO938.

The entire nucleotide sequence of UNQ475 (DNA56433-1406) is shown in FIG. 199 (SEQ ID NO:471). Clone UNQ475 (DNA56433-1406) contains a single open reading frame with an apparent translational initiation site at nucleotide positions 134–136 and ending at the stop codon at nucleotide positions 1181–1183 (FIG. 199). The predicted polypeptide precursor is 349 amino acids long (FIG. 200). The full-length PRO938 protein shown in FIG. 200 has an estimated molecular weight of about 38,952 daltons and a pI of about 4.34. Analysis of the full-length PRO938 sequence shown in FIG. 200 (SEQ ID NO:472) evidences the presence of the following features: a signal peptide from amino 1 to about amino acid 22, a transmembrane domain from about amino acid 191 to about amino acid 211, a potential N-glycosylation site from about amino acid 46 to about amino acid 49, a region homologous to disulfide isomerase from about amino acid 56 to about amino acid 72, and a region having sequence identity with flavodoxin proteins from about amino acid 173 to about amino acid 187.

Clone UNQ475 (DNA56433-1406) has been deposited with ATCC on May 12, 1998, and is assigned ATCC Accession No. 209857.

Analysis of the amino acid sequence of the full-length PRO938 polypeptide suggests that it possesses significant sequence similarity to protein disulfide isomerase, thereby indicating that PRO938 may be a novel protein disulfide isomerase. An analysis of the Dayhoff database (version 35.45 SwissProt 35) evidenced significant homology between the PRO938 amino acid sequence and the following Dayhoff sequences, P_W03626, P_W03627, P_R70491, GARP_PLAFF, XLU85970_1, ACADISPROA_1, IE68_HSVSA, KSU52064_1, U93872_83, P_R97866.

Example 82

Isolation of cDNA Clones Encoding Human PRO1082

A consensus DNA sequence was assembled relative to other EST sequences using phrap as described in Example 1 above, wheein the consensus sequence is herein designated DNA38097. Based on this consensus sequence, oligonucleotides were synthesized: 1) to identify by PCR a cDNA library that contained the sequence of interest, and 2) for use as probes to isolate a clone of the full-length coding sequence for PRO1082.

A set of PCR primers (two forward and one reverse) were synthesized:

```
forward primer 1
5'-GTCCACAGACAGTCATCTCAGGAGCAG-3';   (SEQ ID NO:478)

forward primer 2
5'-ACAAGTGTCTTCCCAACCTG-3';           (SEQ ID NO:479)

reverse primer 1
5'-ATCCTCCCAGAGCCATGGTACCTC-3'.       (SEQ ID NO:480)
```

Additionally, a synthetic oligonucleotide hybridization probe was constructed from the DNA38097 consensus sequence which had the following nucleotide sequence:

```
hybridization probe                          (SEQ ID NO:481)
5'-CCAAGGATAGCTGTTGTTTCAGAGAAAGGATCGTGTGCTGCATCTCCT
CCT-3'.
```

In order to screen several libraries for a source of a full-length clone, DNA from the libraries was screened by PCR amplification with the PCR primers identified above. A positive library was then used to isolate clones encoding the PRO1082 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO1082 [herein designated as UNQ539 (DNA53912-1457)] (SEQ ID NO:476) and the derived protein sequence for PRO1082.

The entire nucleotide sequence of UNQ539 (DNA53912-1457) is shown in FIG. 201 (SEQ ID NO:476). Clone UNQ539 (DNA53912-1457) contains a single open reading frame with an apparent translational initiation site at nucleotide positions 160–162 and ending at the stop codon at nucleotide positions 763–765 (FIG. 201). The predicted polypeptide precursor is 201 amino acids long (FIG. 202). The full-length PRO1082 protein shown in FIG. 202 has an estimated molecular weight of about 22,563 daltons and a pI of about 4.87. Clone UNQ539 (DNA53912-1457) has been deposited with the ATCC. Regarding the sequence, it is understood that the deposited clone contains the correct sequence, and the sequences provided herein are based on known sequencing techniques.

Still analyzing the amino acid sequence of SEQ ID NO:477, the transmembrane domain is at about amino acids 45–65 of SEQ ID NO:477. A cAMP- and cGMP-dependent protein kinase phosphorylation site is at about amino acids 197–200 of SEQ ID NO:477. N-myristoylation sites are at about amino acids 35–40 and 151–156 of SEQ ID NO:477. The regions which share sequence identity with the LDL receptor are at about amino acids 34–67 and 70–200 of SEQ ID NO:477. The corresponding nucleotides of these amino acid regions and others can be routinely determined given the sequences provided herein.

Example 83

Isolation of cDNA Clones Encoding Human PRO1083

A cDNA sequence was identified using the amylase screening technique described in Example 2 above, wherein that cDNA sequence is designated herein as DNA24256 (FIG. 205; SEQ ID NO:484). That cDNA sequence was then compared and aligned with other known EST sequencees as described in Example 1 above to obtain a consensus DNA sequence which is designated herein as DNA43422. Based on the DNA 43422 consensus sequence, oligonucleotides were synthesized: 1) to identify by PCR a cDNA library that contained the sequence of interest, and 2) for use as probes to isolate a clone of the full-length coding sequence for PRO1083.

A pair of PCR primers (forward and reverse) were synthesized:

```
forward PCR primer
5'-GGCATTGGAGCAGTGCTGGGTG-3';    (SEQ ID NO:485)

reverse PCR primer
```

```
                    -continued
5'-TGGAGGCCTAGATGCGGCTGGACG-3'.  (SEQ ID NO:486)
```

In order to screen several libraries for a source of a full-length clone, DNA from the libraries was screened by PCR amplification with the PCR primer pair identified above. A positive library was then used to isolate clones encoding the PRO1083 gene using the reverse PCR primer. RNA for construction of the cDNA libraries was isolated from human fetal kidney tissue (LIB227).

DNA sequencing of the clones isolated as described above gave the full-length DNA sequence for PRO1083 [herein designated as UNQ540 (DNA50921-1458)] (SEQ ID NO:482) and the derived protein sequence for PRO1083.

The entire nucleotide sequence of UNQ540 (DNA50921-1458) is shown in FIG. 203 (SEQ ID NO:482). Clone UNQ540 (DNA50921-1458) contains a single open reading frame with an apparent translational initiation site at nucleotide positions 214–216 and ending at the stop codon at nucleotide positions 2293–2295 (FIG. 203). The predicted polypeptide precursor is 693 amino acids long (FIG. 204). The full-length PRO1083 protein shown in FIG. 204 has an estimated molecular weight of about 77,738 daltons and a pI of about 8.87. Clone UNQ540 (DNA50921-1458) has been deposited with the ATCC. Regarding the sequence, it is understood that the deposited clone contains the correct sequence, and the sequences provided herein are based on known sequencing techniques.

Still analyzing the amino acid sequence of SEQ ID NO:483, the putative signal peptide is at about amino acids 1–25 of SEQ ID NO:483. The transmembrane domains are at about amino acids 382–398, 402–420, 445–468, 473–491, 519–537, 568–590 and 634–657 of SEQ ID NO:483. A microbodies C-terminal targeting signal is at about amino acids 691–693 of SEQ ID NO:483. cAMP- and cGMP-dependent protein kinase phosphorylation sites are at about amino acids 198–201 and 370–373 of SEQ ID NO:483. N-glycosylation sites are at about amino acids 39–42, 148–151, 171–174, 234–237, 303–306, 324–227 and 341–344 of SEQ ID NO:483. A G-protein coupled receptor family domain is at about amino acids 475–504 of SEQ ID NO:483. The corresponding nucleotides can be routinely determined given the sequences provided herein.

Example 84

Isolation of cDNA Clones Encoding Human PRO200

Probes based on an expressed sequence tag (EST) identified from the Incyte Pharmaceuticals database due to homology with VEGF were used to screen a cDNA library derived from the human glioma cell line G61. In particular, Incyte Clone "INC1302516" was used to generate the following four probes:

```
ACTTCTCAGTGTCCATAAGGG;                              (SEQ ID NO:489)

GAACTAAAGAGAACCGATACCATTTTCTGGCCAGGTTGTC;           (SEQ ID NO:490)

CACCACAGCGTTTAACCAGG; and                           (SEQ ID NO:491)

ACAACAGGCACAGTTCCCAC.                               (SEQ ID NO:492)
```

Nine positives were identified and characterized. Three clones contained the full coding region and were identical in sequence. Partial clones were also identified from a fetal lung library and were identical with the glioma-derived sequence with the exception of one nucleotide change which did not alter the encoded amino acid.

Example 85

Expression Constructs for PRO200

For mammalian protein expression, the entire open reading frame (ORF) was cloned into a CMV-based expression vector. An epitope-tag (FLAG, Kodak) and Histidine-tag (His8) were inserted between the ORF and stop codon. VEGF-E-His8 and VEGF-E-FLAG were transfected into human embryonic kidney 293 cells by SuperFect (Qiagen) and pulse-labeled for 3 hours with [$^{35}$S]methionine and [$^{35}$C]cysteine. Both epitope-tagged proteins co-migrate when 20 microliters of 15-fold concentrated serum-free conditioned medium were electrophoresed on a polyacrylamide gel (Novex) in sodium dodecyl sulfate sample buffer (SDS-PAGE). The VEGF-E-IgG expression plasmid was constructed by cloning the ORF in front of the human Fc (IgG) sequence.

The VEGF-E-IgG plasmid was co-transfected with Baculogold Baculovirus DNA (Pharmingen) using Lipofectin (GibcoBRL) into $10^5$ Sf9 cells grown in Hink's TNM-FH medium (JRH Biosciences) supplemented with 10% fetal bovine serum. Cells were incubated for 5 days at 28° C. The supernatant was harvested and subsequently used for the first viral amplification by infecting Sf9 cells at an approximate multiplicity of infection (MOI) of 10. Cells were incubated for 3 days, then supernatant harvested, and expression of the recombinant plasmid determined by binding of 1 ml of supernatant to 30 µl of Protein-A Sepharose CL-4B beads (Pharmacia) followed by subsequent SDS-PAGE analysis. The first amplification supernatant was used to infect a 500 ml spinner culture of Sf9 cells grown in ESF-921 medium (Expression Systems LLC) at an approximate MOI of 0.1. Cells were treated as above, except harvested supernatant was sterile filtered. Specific protein was purified by binding to Protein-A Sepharose 4 Fast Flow (Pharmacia) column.

Example 86

Northern Blot Analyses for PRO200

Blots of human poly(A)+ RNA from multiple adult and fetal tissues and tumor cell lines were obtained from Clontech (Palo Alto, Calif.). Hybridization was carried out using $^{32}$P-labeled probes containing the entire coding region and washed in 0.1×SSC, 0.1% SDS at 63° C.

VEGF-E mRNA was detectable in fetal lung, kidney, brain, liver and adult heart, placenta, liver, skeletal muscle, kidney, and pancreas. VEGF-E mRNA was also found in A549 lung adenocarcinoma and HeLa cervical adenocarcinoma cell lines.

Example 87

In Situ Hybridization of Human Fetal Tissue Sections for PRO200

Formalin-fixed, paraffin-embedded human fetal brain, liver, lower limb, small intestine, thyroid, lymph node, thymus, stomach, trachea, skin, spleen, spinal cord, adrenal, placenta, cord, and adult liver, pancreas, lung, spleen, lymph node, adrenal, heart, aorta, and skin were sectioned, deparaffinized, deproteinated in proteinase K (20 μg/ml) for 15 minutes at 37° C., and further processed for in situ hybridization as described by Lu L H and Gillett N A (Cell Vision 1:169–176, 1994). A [α-$^{33}$-p]UTP-labeled antisense riboprobe was generated from a PCR product of 980 bp (primers GGCGGAATCCAACCTGAGTAG and GCGGCTATCCTCCTGTGCTC, SEQ ID NOS: 493 and 494, respectively). The slides were dipped in Kodak NTB2 nuclear track emulsion and exposed for 4 weeks.

VEGF-E mRNA expression included localization at the growth plate region and embracing fetal myocytes.

Example 88

Myocyte Hypertrophy Assay for PRO200

Myocytes from neonatal Harlan Sprague Dawley rat heart ventricle (23 days gestation) were plated in duplicate at 75000 cells/ml in a 96-well plate. Cells were treated for 48 h with 2000, 200, 20, or 2 ng/ml VEGF-E-IgG. Myocytes were stained with crystal violet to visualize morphology and scored on a scale of 3 to 7, 3 being nonstimulated and 7 being full-blown hypertrophy.

2000 ng/ml and 200 ng/ml VEGF-E caused hypertrophy, scored as a 5.

Example 89

Cell Proliferation Assay for PRO200

Mouse embryonic fibroblast C3H1OT1/2 cells (ATCC) were grown in 50:50 Ham's F-12: low glucose DMEM medium containing 10% fetal calf serum (FCS). Cells were plated in duplicate in a 24-well plate at 1000, 2000, and 4000 cells/well. After 48 hours, cells were switched to medium containing 2% FCS and were incubated for 72 hours with 200, 800, or 2000 ng/ml VEGF-E or no growth factor added.

Approximately 1.5 fold greater number of cells were measured in the presence of 200 ng/ml VEGF-E as in its absence, at all three cell densities.

Example 90

Endothelial Cell Survival Assay for PRO200

Human umbilical vein endothelial cells (HUVEC, Cell Systems) were maintained in Complete Media (Cell Systems) and plated in triplicate in serum-free medium (Basic Media from Cell Systems containing 0.1% BSA) at 20,000 cells/well of a 48-well plate. Cells were incubated for 5 days with 200 or 400 ng/ml VEGF-E-IgG, 100 ng/ml VEGF, 20 ng/ml basic FGF, or no addition.

Survival was 2–3 times greater with VEGF-E as compared to lack of growth factor addition. VEGF and basic FGF were included as positive controls.

Example 91

Isolation of cDNA Clones Encoding Human PRO285

A proprietary expressed sequence tag (EST) DNA database (LIFESEQ™, Incyte Pharmaceuticals, Palo Alto, Calif.) was searched and an EST (#2243209) was identified which showed homology to the *Drosophila* Toll protein.

Based on the EST, a pair of PCR primers (forward and reverse):

```
                                        (SEQ ID NO:499)
TAAAGACCCAGCTGTGACCG (SEQ ID NO:500)
ATCCATGAGCCTCTGATGGG, and a probe:
                                        (SEQ ID NO:501)
ATTTATGTCTCGAGGAAAGGGACTGGTTACCAGGGCAGCCAGTTC
``` were synthesized.

mRNA for construction of the cDNA libraries was isolated from human placenta tissue. The cDNA libraries used to isolate the cDNA clones were constructed by standard methods using commercially available reagents such as those from Invitrogen, San Diego, Calif. (Fast Track 2). The cDNA was primed with oligo dT containing a NotI site, linked with blunt to SalI hemikinased adaptors, cleaved with NotI, sized appropriately by gel electrophoresis, and cloned in a defined orientation into the cloning vector pCR2.1 (Invitrogen, Inc.) using reagents and protocols from Life Technologies, Gaithersburg, Md. (Super Script Plasmid System). The double stranded cDNA was sized to greater than 1000 bp and the cDNA was cloned into BamHI/NotI cleaved vector. pCR2.1 is a commercially available plasmid, designed for easy cloning of PCR fragments, that carries AmpR and KanR genes for selection, and LacZ gene for blue-white selection.

In order to screen several libraries for a source of a full-length clone, DNA from the libraries was screened by PCR amplification with the PCR primer pair identified above. A positive library was then used to isolate clones encoding the PRO285 gene using the probe oligonucleotide and one of the PCR primers.

A cDNA clone was sequenced in entirety. The entire nucleotide sequence of DNA40021-1154 (encoding PRO285) is shown in FIG. 208 (SEQ ID NO:495). Clone DNA40021-1154 contains a single open reading frame with an apparent translational initiation site at nucleotide positions 61–63 (FIG. 208). The predicted polypeptide precursor is 1049 amino acids long, including a putative signal peptide at amino acid positions 1–29, a putative transmembrane domain between amino acid positions 837–860, and a leucine zipper pattern at amino acid positions 132–153 and 704–725, respectively. It is noted that the indicated boundaries are approximate, and the actual limits of the indicated regions might differ by a few amino acids. Clone DNA40021-1154 has been deposited with ATCC (designation: DNA40021-1154) and is assigned ATCC deposit no.209389.

Based on a BLAST and FastA sequence alignment analysis (using the ALIGN computer program) of the full-length sequence is a human analogue of the *Drosophila* Toll protein, and is homologous to the following human Toll proteins: Toll1 (DNAX# HSU88540-1, which is identical with the random sequenced full-length cDNA #HUMRSC786-1); Toll2 (DNAX# HSU88878-1); Toll3 (DNAX# HSU88879-1); and Toll4 (DNAX# HSU88880-1).

Example 92

Isolation of cDNA Clones Encoding Human PRO286

A proprietary expressed sequence tag (EST) DNA database (LIFESEQ™, Incyte Pharmaceuticals, Palo Alto, Calif.) was searched and an EST (#694401) was identified which showed homology to the *Drosophila* Toll protein.

Based on the EST, a pair of PCR primers (forward and reverse):

```
                                              (SEQ ID NO:502)
GCCGAGACAAAAACGTTCTCC (SEQ ID NO:503)
CATCCATGTTCTCATCCATTAGCC, and a probe:
                                              (SEQ ID NO:504)
TCGACAACCTCATGCAGAGCATCAACCAAAGCAAGAAAACAGTATT
``` were synthesized.

mRNA for construction of the cDNA libraries was isolated from human placenta tissue. This RNA was used to generate an oligo dT primed cDNA library in the vector pRK5D using reagents and protocols from Life Technologies, Gaithersburg, Md. (Super Script Plasmid System). pRK5D is a cloning vector that has an sp6 transcription initiation site followed by an SfiI restriction enzyme site preceding the XhoI/NotI cDNA cloning sites. The cDNA was primed with oligo dT containing a NotI site, linked with blunt to SalI hemiknased adaptors, cleaved with NotI, sized to greater than 1000 bp appropriately by gel electrophoresis, and cloned in a defined orientation into XhoI/NotI-cleaved pRK5D.

In order to screen several libraries for a source of a full-length clone, DNA from the libraries was screened by PCR amplification with the PCR primer pair identified above. A positive library was then used to isolate clones encoding the PRO286 gene using the probe oligonucleotide identified above and one of the PCR primers.

A cDNA clone was sequenced in entirety. The entire nucleotide sequence of DNA42663-1154 (encoding PRO286) is shown in FIG. 210 (SEQ ID NO:497). Clone DNA42663-1154 contains a single open reading frame with an apparent translational initiation site at nucleotide positions 57–59 (FIG. 211). The predicted polypeptide precursor is 1041 amino acids long, including a putative signal peptide at amino acid positions 1–26, a potential transmembrane domain at amino acid positions 826–848, and leucine zipper patterns at amino acids 130–151, 206–227, 662–684, 669–690 and 693–614, respectively. It is noted that the indicated boundaries are approximate, and the actual limits of the indicated regions might differ by a few amino acids. Clone DNA42663-1154 has been deposited with ATCC (designation: DNA42663-1154) and is assigned ATCC deposit no. 209386.

Based on a BLAST and FastA sequence alignment analysis (using the ALIGN computer program) of the full-length sequence of PRO286, it is a human analogue of the *Drosophila* Toll protein, and is homologous to the following human Toll proteins: Toll1 (DNAX# HSU88540-1, which is identical with the random sequenced full-length cDNA #HUMRSC786-1); Toll2 (DNAX# HSU88878-1); Toll3 (DNAX# HSU88879-1); and Toll4 (DNAX# HSU88880-1).

Example 93

NF-κB Assay for PRO285 and PRO286

As the Toll proteins signal through the NF-κB pathway, their biological activity can be tested in an NF-κB assay. In this assay Jurkat cells are transiently transfected using Lipofectamine reagent (Gibco BRL) according to the manufacturer's instructions. 1 µg pB2XLuc plasmid, containing NF-κB -driven luciferase gene, is contransfected with 1 µg pSRαN expression vector with or without the insert encoding PRO285 or PRO286. For a positive control, cells are treated with PMA (phorbol myristyl acetate; 20 ng/ml) and PHA (phytohaemaglutinin, 2 µg/ml) for three to four hours. Cells are lysed 2 or 3 days later for measurement of luciferase activity using reagents from Promega.

Example 94

Isolation of cDNA Clones Encoding Human PRO213-1, PRO1330 and PRO1449

A consensus DNA sequence was assembled relative to other EST sequences using phrap as described in Example 1 above. This consensus sequence is herein designated DNA28735. Based on the DNA28735 consensus sequence, oligonucleotides were synthesized: 1) to identify by PCR a cDNA library that contained the sequence of interest, and 2) for use as probes to isolate a clone of the full-length coding sequence for PRO213-1, PRO1330 and/or PRO1449. A pair of PCR primers (forward and reverse) were synthesized:

```
forward PCR primer
5'-TGGAGCAGCAATATGCCAGCC-3'          (SEQ ID NO:511)

reverse PCR primer
5'-TTTTCCACTCCTGTCGGGTTGG-3'         (SEQ ID NO:512)
```

Additionally, a synthetic oligonucleotide hybridization probe was constructed from the consensus DNA28735 sequence which had the following nucleotide sequence:

```
hybridization probe                     (SEQ ID NO:513)
5'-GGTGACACTTGCCAGTCAGATGTGGATGAATGCAGTGCTAGGAGGG-
3'
```

In order to screen several libraries for a source of a full-length clone, DNA from the libraries was screened by PCR amplification with the PCR primer pair identified above. A positive library was then used to isolate clones encoding the PRO213-1, PRO1330 and/or PRO1449 gene using the probe oligonucleotide and one of the PCR primers. RNA for construction of the cDNA libraries was isolated from human fetal lung tissue.

DNA sequencing of the clones isolated as described above gave the full-length DNA sequence encoding PRO213-1, PRO1330 and/or PRO1449 [DNA30943-1-1163-1 (SEQ ID NO:505), DNA64907-1163-1 (SEQ ID NO:507) and DNA64908-1163-1 (SEQ ID NO:509), respectively].

The entire nucleotide sequences corresponding to DNA30943-1-1163-1 (SEQ ID NO:505), DNA64907-1163-1 (SEQ ID NO:507) and DNA64908-1163-1 (SEQ ID NO:509), respectively. DNA30943-1163, DNA64907-1163-1 and DNA64908-1163-1 contain a single open reading frame with an apparent translational initiation site at nucleotide positions 398–401, 488–490 and 326–328, respectively, and ending at the stop codon at nucleotide positions 1221–1223, 1307–1309 and 1145–1147, respectively (FIGS. 212, 214 and 216). The predicted polypeptide precursor is 295, 273 and 273 amino acids long, respectively (FIGS. 119, 215 and 217). DNA30943-1-1163-1, DNA64907-1163-1 and DNA64908-1163-1 have been deposited with ATCC and are assigned ATCC deposit no. 209791, 203242 and 203243, respectively.

Analysis of the amino acid sequence of the full-length PRO213-1 polypeptide suggests that a portion of it possess significant homology to the human growth arrest-specific gene 6 protein. More specifically, an analysis of the Dayhoff database (version 35.45 SwissProt 35) evidenced significant homology between the PRO213 amino acid sequence and the following Dayhoff sequences, HSMHC3W5A_6 and B48089.

The EST databases included public EST databases (e.g., GenBank) and a proprietary EST database (LIFESEQ™, Incyte Pharmaceuticals, Palo Alto, Calif.). The search was performed using the computer program BLAST or BLAST2 (Altshul et al., Methods in Enzymology 266: 469–480 [1996]). Those comparisons resulting in a BLAST score of 70 (or in some cases 90) or greater that did not encode proteins were clustered and assembled into consensus DNA sequences with the program "phrap" (Phil Green, University of Washington, Seattle, Wash.).

A consensus DNA sequence was assembled relative to other EST sequences using phrap. A consensus sequence was determined, which was then extended using repeated cycles of BLAST and phrap to extend the consensus sequence as far as possible using the sources of EST sequences discussed above. The extended assembly sequence was designated DNA35861. Based on the DNA35861 consensus sequence, oligonucleotides were synthesized: 1) to identify by PCR a cDNA library that contained the sequence of interest, and 2) for use as probes to isolate a clone of the full-length coding sequence of PRO298. Forward and reverse primers generally range from 20 to 30 nucleotides and are often designed to give a PCR product of about 100–1000 bp in length. The probe sequence is typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., Current Protocols in Molecular Biology, with the PCR primer pair. A positive library was used to isolate clones encoding the gene of interest using the probe oligonucleotide and one of the primer pairs.

PCR primers (forward and reverse) and a hybridization probe were synthesized:

```
forward PCR primer 1
CAACGTGATTTCAAAGCTGGGCTC                                        (SEQ ID NO:517)

forward PCR primer 2
GCCTCGTATCAAGAATTTCC                                            (SEQ ID NO:518)

forward PCR primer 3
AGTGGAAGTCGACCTCCC                                              (SEQ ID NO:519)

reverse PCR primer 1
CTCACCTGAAATCTCTCATAGCCC                                        (SEQ ID NO:520)

hybridization probe 1
CGCAAAACCCATTTTGGGAGCAGGAATTCCAATCATGTCTGTGATGGTGG              (SEQ ID NO:521)
```

Additional analysis of the amino acid sequence of the full-length PRO1330 and PRO1449 polypeptide indicates significant identity with notch4. More specifically, an analysis of the Dayhoff database (version 35.130 SwissProt 35) evidenced significant identity between PRO1330 and the following Dayhoff sequences, D86566_1 and NEL_HUMAN.

Example 95

Isolation of cDNA Clones Encoding Human PRO298

A cDNA isolated in the amylase screen described in Example 2 above is herein designated DNA26832 (FIG. 220; SEQ ID NO:516). The sequence of DNA26832 was then used to search expressed sequence tag (EST) databases.

In order to screen several libraries for a source of a full-length clone, DNA from the libraries was screened by PCR amplification with the PCR primer pair identified above. A positive library was then used to isolate clones encoding the PRO298 gene using the probe oligonucleotide and one of the PCR primers.

RNA for construction of the cDNA libraries was isolated from human fetal lung tissue (LIB25). The cDNA libraries used to isolated the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science,* 253: 1278–1280 (1991)) in the unique XhoI and NotI sites.

DNA sequencing of the clones isolated as described above gave the full-length DNA sequence for PRO298 (herein designated UNQ261 [DNA39975-1210]) (SEQ ID NO:514), and the derived protein sequence for PRO298 (SEQ ID NO:515).

The entire nucleotide sequence of UNQ261 (DNA39975-1210) is shown in FIG. 218 (SEQ ID NO:514). Clone DNA39975-1210 contains a single open reading frame with an apparent translational initiation site at nucleotide positions 375–377. The predicted polypeptide precursor is 364 amino acids long. The protein contains four putative transmembrane domains between amino acid positions 36-55 (type II TM), 65–84, 188–208, and 229–245, respectively. A putative N-linked glycosylation site starts at amino acid position 253. In addition, the following features have been identified in the protein sequence: cAMP- and cGMP-dependent protein kinase phosphorylation site, starting at position 8; N-myristoylation sites starting a position 173 and 262, respectively; and a ZP domain between amino acid positions 45–60. Clone DNA39975-1210 has been deposited with ATCC (Apr. 21, 1998) and is assigned ATCC deposit no.209783.

Example 96

Isolation of cDNA Clones Encoding Human PRO337

A cDNA sequence identified in the amylase screen described in Example 2 above is herein designated DNA42301 (FIG. 223, SEQ ID NO:524). The DNA42301 sequence was then compared to other EST sequences using phrap as described in Example 1 above and a consensus sequence designated herein as DNA28761 was identified. Based on this consensus sequence, oligonucleotides were synthesized: 1) to identify by PCR a cDNA library that contained the sequence of interest, and 2) for use as probes to isolate a clone of the full-length coding sequence. In order to screen several libraries for a source of a full-length clone, DNA from the libraries was screened by PCR amplification with the PCR primer pair identified above. A positive library was then used to isolate clones encoding the PRO337 gene using the probe oligonucleotide and one of the PCR primers. RNA for construction of the cDNA libraries was isolated from human fetal brain.

A cDNA clone was sequenced in its entirety. The full length nucleotide sequence of DNA43316-1237 is shown in FIG. 221 (SEQ ID NO:522). Clone DNA43316-1237 contains a single open reading frame with an apparent translational initiation site at nucleotide positions 134–136 (FIG. 221; SEQ ID NO:522). The predicted polypeptide precursor is 344 amino acids long. Clone DNA43316-1237 has been deposited with ATCC and is assigned ATCC deposit no. 209487

Based on a BLAST-2 and FastA sequence alignment analysis of the fi ill-length sequence, PRO337 shows amino acid sequence identity to rat neurotriin (97%).

Example 97

Isolation of cDNA Clones Encoding Human PRO403

Introduction:

Human thrombopoietin (THPO) is a glycosylated hormone of 352 amino acids consisting of two domains. The N-terminal domain, sharing 50% similarity to erythropoietin, is responsible for the biological activity. The C-terminal region is required for secretion. The gene for thrombopoictin (THPO) maps to human chromosome 3q27–q28 where the six exons of this gene span 7 kilobasebase pairs of genomic DNA (Chang et al., Genomics 26: 636–7 (1995); Foster et al., Proc. Nati. Acad. Sci. USA 91: 13023–7 (1994); Gurney et al., Blood 85: 981–988 (1995). In order to determine whether there were any genes encoding THPO homologues located in close proximity to THPO, genomic DNA fragments from this region were identified and sequenced. Three P1 clones and one PAC clones (Genome Systems Inc., St. Louis, Mo.; cat. Nos. P1-2535 and PAC-6539) encompassing the THPO locus were isolated and a. 140 kb region was sequenced using the ordered shotgun strategy (Chen et al., Genomics 17: 651–656 (1993)), coupled with a PCR-based gap filling approach. Analysis reveals that the region is gene-rich with four additional genes located very close to THPO: tumor necrosis factor-receptor type 1 associated protein 2 (TRAP2) and elongation initiation factor gamma (elF4g), chloride channel 2 (CLCN2) and RNA polymerase II subunit hRPB17. While no THPO homolog was found in the region, four novel genes have been predicted by computer-assisted gene detection (GRAIL)(Xu et al., Gen. Engin. 16: 241–253 (1994), the presence of CpG islands (Cross, S. and Bird, A., Curr. Opin. Genet. & Devel. 5: 109–314 (1995), and homology to known genes (as detected by WU-BLAST2.0)(Altschul and Gish, Methods Enzymol. 266: 460–480 (1996).

Procedures:

P1 and PAC Clones:

The initial human P1 clone was isolated from a genomic P1 library (Genome Systems Inc., St. Louis, Mo.; cat. no.: P1-2535) screened with PCR primers designed from the THPO genomic sequence (A. L. Gurney, et al., Blood 85: 981–88 (1995). PCR primers were designed from the end sequences derived from this P1 clone were then used to screen P1 and PAC libraries (Genome Systems, Cat. Nos.: P1-2535 & PAC-6539) to identify overlapping clones (PAC1, p1.t, and P1.u). The 3'-end sequence from PAC.z was used to define the primers used for the screening of a human BAC library (Genome Systems Inc., St. Louis, Mo.; Cat. No.: BDTW-4533A).

Ordered Shotgun Strategy:

The Ordered Shotgun Strategy (OSS) (Chen et al., Genomics 17:651–656 (1993)) involves the mapping and sequencing of large genomic DNA clones with a hierarchical approach. The P1 or PAC clone was sonicated and the fragments subcloned into lambda vector (λBluestar) (Novagen, Inc., Madison, Wis.; cat. no. 69242-3). The lambda sub clone inserts were isolated by long-range PCR (Barnes, W. Proc. Natl. Acad. Sci. USA 91: 2216–2220 (1994) and the ends sequenced. The lambda-end sequences were overlapped to create a partial map of the original clone. Those lambda clones with overlapping end-sequences were identified, the insets subcloned into a plasmid vector (pUC18 or pUC19, Hoefer Pharmacia Biotech, Inc., San Francisco, Calif., Cat. Nos. 27-4949-01 and 27-4951-01) and the ends of the plasmid subclones were sequenced and assembled to generate a contiguous sequence. This directed sequencing strategy minimizes the redundancy required while allowing one to scan for and concentrate on interesting regions.

In order to define better the THPO locus and to search for other genes related to the hematopoietin family, five genomic clones were isolated from this region by PCR screening of human P1 and PAC libraries (Genome System, Inc., Cat. Nos.: P1-2535 and PAC-6539).

The sizes of the genomic fragments are as follows: P1.t is 40 kb; P1.g is 70 kb; P1.u is 70 kb; PAC.z is 200 kb; and BAC.1 is 80 kb. Approximately 75% (140 kb) of the 190 kb genomic DNA region was sequenced by the Ordered Shotgun Strategy (OSS) (Chen et al., Genomics 17: 651–56 (1993), and assembled into contigs using AutoAssembler™ (Applied Biosystems, Perkin Elmer, Foster City, Calif., cat. no. 903227). The preliminary order of these contigs was determined by manual analysis. There were 47 contigs the 140 kb region. A PCR-based approach to ordering the contigs and filling in the gaps was employed. The following summarizes the number and sizes of the gaps. The 50 kb of sequence unique to BAC.1 was sequenced by a total shotgun approach with a ten-fold redundancy.

| Size of gap | number |
|---|---|
| <50 bp | 13 |
| 50–150 bp | 7 |
| 150–300 bp | 7 |
| 300–1000 bp | 10 |
| 1000–5000 bp | 7 |
| >5000 bp | 2 ((15,000 bp) |

DNA Sequencing:

ABI DYE-primer™ chemistry (PE Applied Biosystems, Foster City, Calif.; Cat. No.: 402112) was used to end-sequence the lambda and plasmid subclones. ABI DYE-terminater™ chemistry (PE Applied Biosystems, Foster City, Calif., Cat. No: 403044) was used to sequence the PCR products with their respective PCR primers. The sequences were collected with an AB1377 instrument. For PCR products larger than 1 kb, walking primers were used. The sequences of contigs generated by the OSS strategy in AutoAssembler™ (PE Applied Biosystems, Foster City, Calif.; Cat. No: 903227) and the gap-filling sequencing trace files were imported into Sequencher™ (Gene Codes Corp., Ann Arbor, Mich.) for overlapping and editing. The sequences generated by the total shotgun strategy were assembled using Phred and Phrap and edited using Consed and GFP (Genome Reconstruction Manager for Phrap), version 1.2.

PCR-Based Gap Filling Strategy:

Primers were designed based on the 5'- and 3'-end sequenced of each contig, avoiding repetitive and low quality sequence regions. All primers were designed to be 19-24-mers with 50–70% G/C content. Oligos were synthesized and gel-purified by standard methods.

Since the orientation and order of the contigs were unknown, permutations of the primers were used in the amplification reactions. Two PCR kits were used: first, XL PCR kit (Perkin Elmer, Norwalk, Conn.; Cat. No.: N8080205), with extension times of approximately 10 minutes; and second, the Taq polymerase PCR kit (Qiagen Inc., Valencia, Calif.; Cat. No.: 201223) was used under high stringency conditions if smeared or multiple products were observed with the XL PCR kit. The main PCR product from each successful reaction was extracted from a 0.9% low melting agarose gel and purified with the Geneclean DNA Purification kit prior to sequencing.

Analysis:

The identification and characterization of coding regions was carried out as follows: First, repetitive sequences were masked using RepeatMasker (A. F. A. Smit & P. Green) which screens DNA sequences in FastA format against a library of repetitive elements and returns a masked query sequence. Repeats not masked were identified by comparing the sequence to the GenBank database using WUBLAST2.0 [Altschul, S & Gish, W., Methods Enzymol. 266: 460–480 (1996)] and were masked manually.

Next, known genes were revealed by comparing the genomic regions against Genentech's protein database using the WUBLAST2.0 algorithm and then annotated by aligning the genomic and cDNA sequences for each gene, respectively, using a Needleman-Wunch (Needleman and Wunsch, J. Mol. Biol. 48: 443–453 (1970) algorithm to find regions of local identity between sequences. The strategy results in detection of all exons of the five known genes in the region, THPO, TRAP2, elF4g, CLCN2 and hRPB17 (see below).

| Known genes | Map position |
|---|---|
| eukaryotic translation initiation factor 4 gamma | 3q27-qter |
| thrombopoietin | 3q26-q27 |
| chloride channel 2 | 3q26-qter |
| TNF receptor associated protein 2 | not previously mapped |
| RNA polymerase II subunit hRPB17 | not previously mapped |

Finally, novel transcription units were predicted using a number of approaches. CpG islands (S. Cross & Bird, A., Curr. Opin. Genet. Dev. 5: 109–314 (1995) islands were used to define promoter regions and were identified as clusters of sites cleaved by enzymes recognizing GC-rich, 6 or 8-mer palindromic sequences (NotI, NarI, BssHII, XhoI. CpG islands are usually associated with promoter regions of genes. WUBLAST2.0 analysis of short genomic regions (10–20 kb) versus GenBank revealed matches to ESTs. The individual EST sequences (or where possible, their sequence chromatogram files) were retrieved and assembled with Sequencer to provide a theoretical cDNA sequence (DNA36443). GRAIL2 (ApoCom Inc., Knoxville, Tenn., command line version for the DEC alpha) was used to predict a novel exon. The five known genes in the region served as internal controls for the success of the GRAIL algorithm.

Isolation:

A partial endothelin converting enzyme-2 (ECE-2) cDNA clone was isolated by first splicing in silico the ECE-2 exons predicted in the genomic sequence to generate a putative sequence (DNA36443). An oligonucleotide probe: GAAG-CAGTGCAGCCAGCAGTAGAGAGGCACCT-GCTAAGA) (SEQ ID NO:530) was designed and used to screen a human fetal small intestine library (LIB110) and internal PCR primers (36443f1) (ECE2.f:ACGCAGCTG-GAGCTGGTCTTAGCA) (SEQ ID NO:531) and (36443r1) (ECE2.r) (GGTACTGGACCCCTAGGGCCACAA) (SEQ ID NO:532) were used to confirm clones hybridizing to the probe prior to sequencing. One positive clone was obtained, however this cDNA (DNA49830) represented a partially spliced transcript containing appropriately spliced exons 1 through 6, followed by intron 6 sequence. The oligo dT primer annealed to a polyA-stretch within an Alu element present in intron 6. An additional ECE-2 cDNA fragment (DNA49831) was obtained by PCR from a human fetal kidney library (LIB227) with primers designed from the presumed cDNA sequence [36443f3: CCTCCCAGC-CGAGACCAGTGG (SEQ ID NO:533) and 36443r2: GGTCCTATAAGGGCCAAGACC (SEQ ID NO:534)]. This PCR product extended from exon 13 into the 3' untranslated region in exon 18.

A full length endothelin converting enzyme 2 (ECE-2) cDNA clone (DNA55800-1263) was isolated from an oligo-dT-primed human fetal brain library. RNA from human fetal brain tissue (20 weeks gestation, #283005)(SRC175) was isolated by guanidine thiocyanate and 5 µg used to generate double stranded cDNA which was cloned into the vector pRK5E. The 3'-primer (pGACTAGTTCTAGATCGC-GAGCGGCCGCCCTTTTTTTTTTTTTTT) (SEQ ID NO:535) and the 5-linker (pCGGACGCGTGGGTCGA) (SEQ ID NO:536) were designed to introduce XhoI and NotI restriction sites. The library was screened with PCR primers [36443pcrf1: CGGCCGTGATGGCTGGTGACG (SEQ ID NO:537) and 36443r3: GGCAGACTCCTTC-CTATGGG (SEQ ID NO:538)] designed from the partial human ECE-2 cDNA sequences (DNA49830 and DNA49831). PCR products were cloned into the vector pCR2.1-TOPO (Invitrogen Corp., Carlsbad, Calif., Cat. No. K4500-01) and sequenced with DYE-terminator chemistry as described above.

Example 98

Northern Blot and in Situ RNA Hybridization Analysis for PRO403

Expression of PRO403 mRNA in human tissues was examined by Northern blot analysis. Human polyA+ RNA blots derived from human fetal and adult tissues (Clontech, Palo Alto, Calif.; Cat. Nos. 7760-1, 7756-1 and 7755-1) were hybridized to a [32P-α]dATP-labelled cDNA fragments from probe based on the full length PRO403 cDNA. Blots were incubated with the probes in hybridization buffer (5×SSPE; 2× Denhardt's solution; 100 mg/mL denatured sheared salmon sperm DNA; 50% formamide; 2% SDS) for 18 hours at 42° C., washed to high stringency (0.1×SSC, 0.1% SDS, 50° C.) and autoradiographed. The blots were developed after overnight exposure by phosphorimager analysis (Fuji).

PRO403 mRNA transcripts were detected. Analysis of the expression pattern showed the strongest signal of the expected 3.3 kb transcript in adult brain (highest in the cerebellum, putamen, medulla, and temporal lobe, and lower in the cerebral cortex, occipital lobe and frontal lobe), spinal cord, lung and pancreas and higher levels of a 4.5 kb transcript in fetal brain and kidney.

Example 99

Use of PRO Polypeptide-Encoding Nucleic Acid as Hybridization Probes

The following method describes use of a nucleotide sequence encoding a PRO polypeptide as a hybridization probe.

DNA comprising the coding sequence of of a PRO polypeptide of interest as disclosed herein may be employed as a probe or used as a basis from which to prepare probes to screen for homologous DNAs (such as those encoding naturally-occurring variants of the PRO polypeptide) in human tissue cDNA libraries or human tissue genomic libraries.

Hybridization and washing of filters containing either library DNAs is performed under the following high stringency conditions. Hybridization of radiolabeled PRO polypeptide-encoding nucleic acid-derived probe to the filters is performed in a solution of 50% formamide, 5×SSC, 0.1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence PRO polypeptide can then be identified using standard techniques known in the art.

Example 100

Expression of PRO Polypeptides in E. coli

This example illustrates preparation of an unglycosylated form of a desired PRO polypeptide by recombinant expression in E. coli.

The DNA sequence encoding the desired PRO polypeptide is initially amplified using selected PCR primers. The primers should contain restriction enzyme sites which correspond to the restriction enzyme sites on the selected expression vector. A variety of expression vectors may be employed. An example of a suitable vector is pBR322 (derived from E. coli; see Bolivar et al., Gene, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the specific PRO polypeptide coding region, lambda transcriptional terminator, and an argU gene.

The ligation mixture is then used to transform a selected E. coli strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO polypeptide can then be purified using a metal chelating column under conditions that allow tight binding of the protein.

PRO181, PRO195, PRO200, PRO237, PRO273, PRO540, PRO322, PRO1017, PRO938, PRO162, PRO1114, PRO827 and PRO1008 were expressed in E. coli in a poly-His tagged form, using the following procedure.

The DNA encoding the PRO polypeptide was initially amplified using selected PCR primers. The primers contained restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences were then ligated into an expression vector, which was used to transform an E. coli host based on strain 52 (W3110 fuhA (tonA) lon galE rpoHts(htpRts) clpP(lacIq). Transformants were first grown in LB containing 50 mg/ml carbenicillin at 30° C. with shaking until an O.D.600 of 3–5 was reached. Culture were then diluted 50–100 fold into CRAP media (prepared by mixing 3.57 g $(NH_4)_2SO_4$, 0.71 g sodium citrate·2H2O, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20–30 hours at 30° C. with shaking. Samples were removed to verify expression by SDS-PAGE analysis, and the bulk culture is centrifuged to pellet the cells. Cell pellets were frozen until purification and refolding.

E. coli paste from 0.5 to 1 L fermentations (6–10 g pellets) was resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution was stirred overnight at 4° C. This step results in a denatured protein with all cysteine residues blocked by sulfitolization. The solution was centrifuged at 40,000 rpm in a Beckman Ultracentifuge for 30 min. The supernatant was diluted with 3–5 volumes of metal chelate column buffer (6 M guanidine, 20 mM Tris, pH 7.4) and filtered through 0.22 micron filters to clarify. Depending the clarified extract was loaded onto a 5 ml Qiagen Ni-NTA metal chelate column equilibrated in the metal chelate column buffer. The column was washed with additional buffer containing 50 mM imidazole (Calbiochem, Utrol grade), pH 7.4. The protein was eluted with buffer containing 250 mM imidazole. Fractions containing the desired protein were pooled and stored at 4° C. Protein concentration was estimated by its absorbance at 280 nm using the calculated extinction coefficient based on its amino acid sequence.

The proteins were refolded by diluting sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes were chosen so that the final protein concentration was between 50 to 100 micrograms/ml. The refolding solution was stirred gently at 4° C. for 12–36 hours. The refolding reaction was quenched by the addition of TFA to a final concentration of 0.4% (pH of approximately 3). Before further purification of the protein, the solution was filtered through a 0.22 micron filter and acetonitrile was added to 2–10% final concentration. The refolded protein was chromatographed on a Poros R1/H reversed phase column using a mobile buffer of 0.1% TFA with elution with a gradient of acetonitrile from 10 to 80%. Aliquots of fractions with A280 absorbance were analyzed on SDS polyacrylamide gels and fractions containing homogeneous refolded protein were pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations.

In addition to resolving misfolded forms of proteins from the desired form, the reversed phase step also removes endotoxin from the samples.

Fractions containing the desired folded PRO proteins were pooled and the acetonitrile removed using a gentle stream of nitrogen directed at the solution. Proteins were formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Many of the PRO polypeptides described herein were successfully expressed as described above.

Example 101

Expression of PRO Polypeptides in Mammalian Cells

This example illustrates preparation of a glycosylated form of a desired PRO polypeptide by recombinant expression in mammalian cells.

The vector, pRK5 (see EP 307,247, published Mar. 15, 1989), is employed as the expression vector. Optionally, the PRO polypeptide-encoding DNA is ligated into pRK5 with selected restriction enzymes to allow insertion of the PRO polypeptide DNA using ligation methods such as described in Sambrook et al., supra. The resulting vector is called pRK5-PRO polypeptide.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-PRO polypeptide DNA is mixed with about 1 μg DNA encoding the VA RNA gene [Thimmappaya et al., Cell, 31:543 (1982)] and dissolved in 500 μl of 1 mM Tris-HCl, 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}$S-cysteine and 200 μCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of PRO polypeptide. The cultures containing transfected cells may undergo further incubation (in serum free medium) and the medium is tested in selected bioassays.

In an alternative technique, PRO polypeptide may be introduced into 293 cells transiently using the dextran sulfate method described by Somparyrac et al., Proc. Natl. Acad. Sci., 12:7575 (1981). 293 cells are grown to maximal density in a spinner flask and 700 μg pRK5-PRO polypeptide DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 µg/ml bovine insulin and 0.1 µg/ml bovine transferrin. After about four days, the conditioned media is centrifuged and filtered to remove cells and debris. The sample containing expressed PRO polypeptide can then be concentrated and purified by any selected method, such as dialysis and/or column chromatography.

In another embodiment, PRO polypeptides can be expressed in CHO cells. The pRK5-PRO polypeptide can be transfected into CHO cells using known reagents such as $CaPO_4$ or DEAE-dextran. As described above, the cell cultures can be incubated, and the medium replaced with culture medium (alone) or medium containing a radiolabel such as $^{35}$S-methionine. After determining the presence of PRO polypeptide, the culture medium may be replaced with serum free medium. Preferably, the cultures are incubated for about 6 days, and then the conditioned medium is harvested. The medium containing the expressed PRO polypeptide can then be concentrated and purified by any selected method.

Epitope-tagged PRO polypeptide may also be expressed in host CHO cells. The PRO polypeptide may be subcloned out of the pRK5 vector. The sub clone insert can undergo PCR to fuse in frame with a selected epitope tag such as a poly-his tag into a Baculovirus expression vector. The poly-his tagged PRO polypeptide insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged PRO polypeptide can then be concentrated and purified by any selected method, such as by $Ni^{2+}$-chelate affinity chromatography.

Stable expression in CHO cells was performed using the following procedure. The proteins were expressed as an IgG construct (immunoadhesin), in which the coding sequences for the soluble forms (e.g. extracellular domains) of the respective proteins were fused to an IgG1 constant region sequence containing the hinge, CH2 and CH2 domains and/or is a poly-His tagged form.

Following PCR amplification, the respective DNAs were subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24: 9 (1774–1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA were introduced into approximately 10 million CHO cells using commercially available transfection reagents Superfect® (Quiagen), Dosper® or Fugene® (Boehringer Mannheim). The cells were grown and described in Lucas et al., supra. Approximately $3 \times 10^{-7}$ cells are frozen in an ampule for further growth and production as described below.

The ampules containing the plasmid DNA were thawed by placement into water bath and mixed by vortexing. The contents were pipetted into a centrifuge tube containing 10 mLs of media and centrifuged at 1000 rpm for 5 minutes. The supernatant was aspirated and the cells were resuspended in 10 mL of selective media (0.2 µm filtered PS20 with 5% 0.2 µm diafiltered fetal bovine serum). The cells were then aliquoted into a 100 mL spinner containing 90 mL of selective media. After 1–2 days, the cells were transferred into a 250 mL spinner filled with 150 mL selective growth medium and incubated at 37° C. After another 2–3 days, a 250 mL 500 mL and 2000 mL spinners were seeded with $3 \times 10^5$ cells/mL. The cell media was exchanged with fresh media by centrifugation and resuspension in production medium. Although any suitable CHO media may be employed, a production medium described in U.S. Pat. No. 5,122,469, issued Jun. 16, 1992 was actually used. 3L production spinner is seeded at $1.2 \times 10^6$ cells/mL. On day 0, the cell number pH were determined. On day 1, the spinner was sampled and sparging with filtered air was commenced. On day 2, the spinner was sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion). Throughout the production, pH was adjusted as necessary to keep at around 7.2. After 10 days, or until viability dropped below 70%, the cell culture was harvested by centrifugation and filtering through a 0.22 µm filter. The filtrate was either stored at 4° C. or immediately loaded onto columns for purification.

For the poly-His tagged constructs, the proteins were purified using a Ni-NTA column (Qiagen). Before purification, imidazole was added to the conditioned media to a concentration of 5 mM. The conditioned media was pumped onto a 6 ml Ni-NTA column equilibrated in 20 mM Hepes, pH 7.4, buffer containing 0.3 M NaCl and 5 mM imidazole at a flow rate of 4–5 ml/min. at 4° C. After loading, the column was washed with additional equilibration buffer and the protein eluted with equilibration buffer containing 0.25 M imidazole. The highly purified protein was subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc containing) constructs of were purified from the conditioned media as follows. The conditioned medium was pumped onto a 5 ml Protein A column (Pharmacia) which had been equilibrated in 20 mM Na phosphate buffer, pH 6.8. After loading, the column was washed extensively with equilibration buffer before elution with 100 mM citric acid, pH 3.5. The eluted protein was immediately neutralized by collecting 1 ml fractions into tubes containing 275 µL of 1 M Tris buffer, pH 9. The highly purified protein was subsequently desalted into storage buffer as described above for the poly-His tagged proteins. The homogeneity was assessed by SDS polyacrylamide gels and by N-terminal amino acid sequencing by Edman degradation.

Many of the PRO polypeptides described herein were successfully expressed as described above.

Example 102

Expression of PRO Polypeptides in Yeast

The following method describes recombinant expression of a desired PRO polypeptide in yeast.

First, yeast expression vectors are constructed for intracellular production or secretion of PRO polypeptides from the ADH2/GAPDH promoter. DNA encoding a desired PRO polypeptide, a selected signal peptide and the promoter is inserted into suitable restriction enzyme sites in the selected plasmid to direct intracellular expression of the PRO polypeptide. For secretion, DNA encoding the PRO polypeptide can be cloned into the selected plasmid, together with DNA encoding the ADH2/GAPDH promoter, the yeast alpha-factor secretory signal/leader sequence, and linker sequences (if needed) for expression of the PRO polypeptide.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO polypeptide can subsequently be isolated and purified by removing the yeast cells from the fermentation medium by centrifugation and then concentrating the medium using selected cartridge filters. The concentrate containing the PRO polypeptide may further be purified using selected column chromatography resins.

Many of the PRO polypeptides described herein were successfully expressed as described above.

Example 103

Expression of PRO Polypeptides in Baculovirus-Infected Insect Cells

The following method describes recombinant expression of PRO polypeptides in Baculovirus-infected insect cells.

The desired PRO polypeptide is fused upstream of an epitope tag contained with a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the PRO polypeptide or the desired portion of the PRO polypeptide (such as the sequence encoding the extracellular domain of a transmembrane protein) is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4–5 days of incubation at 28° C., the released viruses are harvested and used for further amplifications. Viral infection and protein expression is performed as described by O'Reilley et al., Baculovirus expression vectors: A laboratory Manual, Oxford: Oxford University Press (1994).

Expressed poly-his tagged PRO polypeptide can then be purified, for example, by $Ni^{2+}$-chelate affinity chromatography as follows. Extracts are prepared from recombinant virus-infected Sf9 cells as described by Rupert et al., *Nature*, 362:175–179 (1993). Briefly, Sf9 cells are washed, resuspended in sonication buffer (25 mL Hepes, pH 7.9; 12.5 mM $MgCl_2$; 0.1 mM EDTA; 10% Glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% Glycerol, pH 7.8) and filtered through a 0.45 µm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% Glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or western blot with $Ni^{2+}$-NTA-conjugated to alkaline phosphatase (Qiagen). Fractions containing the eluted $His_{10}$-tagged PRO polypeptide are pooled and dialyzed against loading buffer.

Alternatively, purification of the IgG tagged (or Fc tagged) PRO polypeptide can be performed using known chromatography techniques, including for instance, Protein A or protein G column chromatography.

PRO195, PRO526, PRO540, PRO846, PRO362, PRO363, PRO700, PRO707, PRO322, PRO719, PRO1083, PRO868, PRO866, PRO768, PRO788, PRO938, PRO827 and PRO1031 were successfully expressed in baculovirus infected Sf9 insect cells. While the expression was actually performed in a 0.5–2 L scale, it can be readily scaled up for larger (e.g. 8 L) preparations. The proteins were expressed as an IgG construct (immunoadhesin), in which the protein extracellular region was fused to an IgG1 constant region sequence containing the hinge, CH2 and CH3 domains and/or in poly-His tagged forms.

For expression in baculovirus infected Sf9 cells, following PCR amplification, the respective coding sequences were subcloned into a baculovirus expression vector (pb-.PH.IgG for IgG fusions and pb.PH.His.c for poly-His tagged proteins), and the vector and Baculogold® baculovirus DNA (Pharmingen) were co-transfected into 105 *Spodoptera frugiperda* ("Sf9") cells (ATCC CRL 1711), using Lipofectin (Gibco BRL). pb.PH.IgG and pb.PH.His are modifications of the comnercially available baculovirus expression vector pVL1393 (Pharmingen), with modified polylinker regions to include the His or Fc tag sequences. The cells were grown in Hink's TNM-FH medium supplemented with 10% FBS (Hyclone). Cells were incubated for 5 days at 28° C. The supernatant was harvested and subsequently used for the first viral amplification by infecting Sf9 cells in Hink's TNM-FH medium supplemented with 10% FBS at an approximate multiplicity of infection (MOI) of 10. Cells were incubated for 3 days at 28° C. The supernatant was harvested and the expression of the constructs in the baculovirus expression vector was determined by batch binding of 1 ml of supernatant to 25 mL of Ni-NTA beads (QIAGEN) for histidine tagged proteins or Protein-A Sepharose CL-4B beads (Pharmacia) for IgG tagged proteins followed by SDS-PAGE analysis comparing to a known concentration of protein standard by Coomassie blue staining.

The first viral amplification supernatant was used to infect a spinner culture (500 ml) of Sf9 cells grown in ESF-921 medium (Expression Systems LLC) at an approximate MOI of 0.1. Cells were incubated for 3 days at 28° C. The supernatant was harvested and filtered. Batch binding and SDS-PAGE analysis was repeated, as necessary, until expression of the spinner culture was confirmed.

The conditioned medium from the transfected cells (0.5 to 3 L) was harvested by centrifugation to remove the cells and filtered through 0.22 micron filters. For the poly-His tagged constructs, the protein construct were purified using a Ni-NTA column (Qiagen). Before purification, imidazole was added to the conditioned media to a concentration of 5 mM. The conditioned media were pumped onto a 6 ml Ni-NTA column equilibrated in 20 mM Hepes, pH 7.4, buffer containing 0.3 M NaCl and 5 mM imidazole at a flow rate of 4–5 ml/min. at 4° C. After loading, the column was washed with additional equilibration buffer and the protein eluted with equilibration buffer containing 0.25 M imidazole. The highly purified protein was subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc containing) constructs of proteins were purified from the conditioned media as follows. The conditioned media were pumped onto a 5 ml Protein A column (Pharmacia) which had been equilibrated in 20 mM Na phosphate buffer, pH 6.8. After loading, the column was washed extensively with equilibration buffer before elution with 100 mM citric acid, pH 3.5. The eluted protein was immediately neutralized by collecting 1 ml fractions into tubes containing 275 mL of 1 M Tris buffer, pH 9. The highly purified protein was subsequently desalted into storage buffer as described above for the poly-His tagged proteins. The homogeneity of the proteins was verified by SDS polyacrylamide gel (PEG) electrophoresis and N-terminal amino acid sequencing by Edman degradation.

PRO181, PRO195, PRO200, PRO320, PRO237, PRO273, PRO285, PRO337, PRO526, PRO540, PRO846, PRO362, PRO363, PRO617, PRO322, PRO1083, PRO868, 768, PRO792, PRO788, PRO162, PRO1114, PRO827, PRO1075 and PRO1031 were successfully expressed in baculovirus infected Hi5 insect cells. While the expression was actually performed in a 0.5–2 L scale, it can be readily scaled up for larger (e.g. 8 L) preparations.

For expression in baculovirus-infected Hi5 insect cells, the PRO polypeptide-encoding DNA may be amplified with suitable systems, such as Pfu (Stratagene), or fused upstream (5'-of) of an epitope tag contained with a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the PRO polypeptide or the desired portion of the PRO polypeptide (such as the sequence encoding the extracellular domain of a transmembrane protein) is amplified by PCR with primers complementary to the 5' and 3' regions. The 5' primer may incorporate flanking (selected) restriction enzyme sites. The product is then digested with those selected restriction enzymes and subcloned into the expression vector. For example, derivatives of pVL1393 can include the Fc region of human IgG (pb.PH.IgG) or an 8 histidine (pb.PH.His) tag downstream (3'-of) the NAME sequence. Preferably, the vector construct is sequenced for confirmation.

Hi5 cells are grown to a confluency of 50% under the conditions of, 27° C., no CO2, NO pen/strep. For each 150 mm plate, 30 ug of pIE based vector containing PRO polypeptide is mixed with 1 ml Ex-Cell medium (Media: Ex-Cell 401+1/100 L-Glu JRH Biosciences #14401-78P (note: this media is light sensitive)), and in a separate tube, 100 ul of CellFectin (CellFECTIN (GibcoBRL #10362-010) (vortexed to mix)) is mixed with 1 ml of Ex-Cell medium. The two solutions are combined and allowed to incubate at room temperature for 15 minutes. 8 ml of Ex-Cell media is added to the 2 ml of DNA/CellFECTIN mix and this is layered on Hi5 cells that have been washed once with Ex-Cell media. The plate is then incubated in darkness for 1 hour at room temperature. The DNA/CellFECTIN mix is then aspirated, and the cells are washed once with Ex-Cell to remove excess CellFECTIN. 30 ml of fresh Ex-Cell media is added and the cells are incubated for 3 days at 28° C. The supernatant is harvested and the expression of the PRO polypeptide in the baculovirus expression vector can be determined by batch binding of 1 ml of supernatant to 25 mL of Ni-NTA beads (QIAGEN) for histidine tagged proteins or Protein-A Sepharose CL-4B beads (Pharmacia) for IgG tagged proteins followed by SDS-PAGE analysis comparing to a known concentration of protein standard by Coomassie blue staining.

The conditioned media from the transfected cells (0.5 to 3 L) is harvested by centrifugation to remove the cells and filtered through 0.22 micron filters. For the poly-His tagged constructs, the protein comprising the PRO polypeptide is purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4–5 ml/min. at 4° C. After loading, the column is washed with additional equilibration buffer and the protein eluted with equilibration buffer containing 0.25 M imidazole. The highly purified protein is subsequently deslated into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc containing) constructs of proteins are purified from the conditioned media as follows. The conditioned media is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 mL of 1 M Tris buffer, pH 9. The highly purified protein is subsequently desalted into storage buffer as described above for the poly-His tagged proteins. The homogeneity of PRO polypeptide can be assessed by SDS polyacrylamide gels and by N-terminal amino acid sequencing by Edman degradation and other analytical procedures as desired or necessary.

Many of the PRO polypeptides described herein were successfully expressed as described above.

Example 104

Preparation of Antibodies that Bind to PRO Polypeptides

This example illustrates preparation of monoclonal antibodies which can specifically bind to a PRO polypeptide.

Techniques for producing the monoclonal antibodies are known in the art and are described, for instance, in Goding, supra. Immunogens that may be employed include purified PRO polypeptide, fusion proteins containing the PRO polypeptide, and cells expressing recombinant PRO polypeptide on the cell surface. Selection of the immunogen can be made by the skilled artisan without undue experimentation.

Mice, such as Balb/c, are immunized with the PRO polypeptide immunogen emulsified in complete Freund's adjuvant and injected subcutaneously or intraperitoneally in an amount from 1–100 micrograms. Alternatively, the immunogen is emulsified in MPL-TDM adjuvant (Ribi Immunochemical Research, Hamilton, MT) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-PRO polypeptide antibodies.

After a suitable antibody titer has been detected, the animals "positive" for antibodies can be injected with a final intravenous injection of PRO polypeptide. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against the PRO polypeptide. Determination of "positive" hybridoma cells secreting the desired monoclonal antibodies against the PRO polypeptide is within the skill in the art.

The positive hybridoma cells can be injected intraperitoneally into syngeneic Balb/c mice to produce ascites containing the anti-PRO polypeptide monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 105

Chimeric PRO Polypeptides

PRO polypeptides may be expressed as chimeric proteins with one or more additional polypeptide domains added to facilitate protein purification. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS™ extension/affinity purification system (Immunex Corp., Seattle Wash.). The inclusion of a cleavable linker sequence such as Factor XA or enterokinase (Invitrogen, San Diego Calif.) between the purification domain and the PRO polypeptide sequence may be useful to facilitate expression of DNA encoding the PRO polypeptide.

Example 106

Purification of PRO Polypeptides Using Specific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2–3, or a high concentration of a chaotrope such as urea or thiocyanate ion), and PRO polypeptide is collected.

Example 107

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested. Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

Example 108

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (c.f., Hodgson, *Bio/Technology*, 9: 19–21 (1991)).

In one approach, the three-dimensional structure of the PRO polypeptide, or of an PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry*, 31:7796–7801 (1992) or which act as inhibitors, agonists, or antagonists of native peptides as shown by Athauda et al., *J. Biochem.*, 113: 742–746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

Example 109

Ability of PRO Polypeptides to Inhibit Vascular Endothelial Growth Factor (VEGF) Stimulated Proliferation of Endothelial Cell Growth (Assay 9)

The ability of various PRO polypeptides to inhibit VEGF stimulated proliferation of endothelial cells was tested. Polypeptides testing positive in this assay are useful for inhibiting endothelial cell growth in mammals where such an effect would be beneficial, e.g., for inhibiting tumor growth.

Specifically, bovine adrenal cortical capillary endothelial cells (ACE) (from primary culture, maximum of 12–14 passages) were plated in 96-well plates at 500 cells/well per 100 microliter. Assay media included low glucose DMEM, 10% calf serum, 2 mM glutamine, and 1× penicillin/streptomycin/fungizone. Control wells included the following: (1) no ACE cells added; (2) ACE cells alone; (3) ACE cells plus 5 ng/ml FGF; (4) ACE cells plus 3 ng/ml VEGF; (5) ACE cells plus 3 ng/ml VEGF plus 1 ng/ml TGF-beta; and (6) ACE cells plus 3 ng/ml VEGF plus 5 ng/ml LIF. The test samples, poly-his tagged PRO polypeptides (in 100 microliter volumes), were then added to the wells (at dilutions of 1%, 0.1% and 0.01%, respectively). The cell cultures were incubated for 6–7 days at 37° C./5% $CO_2$. After the incubation, the media in the wells was aspirated, and the cells were washed 1× with PBS. An acid phosphatase reaction mixture (100 microliter; 0.1M sodium acetate, pH 5.5, 0.1% Triton X-100, 10 mM p-nitrophenyl phosphate) was then added to each well. After a 2 hour incubation at 37° C., the reaction was stopped by addition of 10 microliters 1N NaOH. Optical density (OD) was measured on a microplate reader at 405 nm.

The activity of PRO polypeptides was calculated as the percent inhibition of VEGF (3 ng/ml) stimulated proliferation (as determined by measuring acid phosphatase activity at OD 405 nm) relative to the cells without stimulation. TGF-beta was employed as an activity reference at 1 ng/ml, since TGF-beta blocks 70–90% of VEGF-stimulated ACE cell proliferation. The results are indicative of the utility of the PRO polypeptides in cancer therapy and specifically in inhibiting tumor angiogenesis. Numerical values (relative inhibition) are determined by calculating the percent inhibition of VEGF stimulated proliferation by the PRO polypeptides relative to cells without stimulation and then dividing that percentage into the percent inhibition obtained by TGF-β at 1 ng/ml which is known to block 70–90% of VEGF stimulated cell proliferation. The results are considered positive if the PRO polypeptide exhibits 30% or greater inhibition of VEGF stimulation of endothelial cell growth (relative inhibition 30% or greater).

The following polypeptides tested positive in this assay: PRO200, PRO322 and PRO320.

Example 110

Retinal Neuron Survival (Assay 52)

This example demonstrates that certain PRO polypeptides have efficacy in enhancing the survival of retinal neuron cells and, therefore, are useful for the therapeutic treatment of retinal disorders or injuries including, for example, treating sight loss in mammals due to retinitis pigmentosum, AMD, etc.

Sprague Dawley rat pups at postnatal day 7 (mixed population: glia and retinal neuronal types) are killed by decapitation following $CO_2$ anesthesia and the eyes are removed under sterile conditions. The neural retina is dissected away from the pigment epithelium and other ocular tissue and then dissociated into a single cell suspension using 0.25% trypsin in $Ca^{2+}$, $Mg^{2+}$-free PBS. The retinas are incubated at 37° C. for 7–10 minutes after which the trypsin is inactivated by adding 1 ml soybean trypsin inhibitor. The cells are plated at 100,000 cells per well in 96 well plates in DMEM/F12 supplemented with N2 and with or without the specific test PRO polypeptide. Cells for all experiments are grown at 37° C. in a water saturated atmosphere of 5% $CO_2$. After 2–3 days in culture, cells are stained with calcein AM then fixed using 4% paraformaldehyde and stained with DAPI for determination of total cell count. The total cells (fluorescent) are quantified at 20× objective magnification using CCD camera and NIH image software for MacIntosh. Fields in the well are chosen at random.

The effect of various concentration of PRO polypeptides are reported herein where percent survival is calculated by dividing the total number of calcein AM positive cells at 2–3 days in culture by the total number of DAPI-labeled cells at 2–3 days in culture. Anything above 30% survival is considered positive.

The following PRO polypeptides tested positive in this assay using polypeptide concentrations within the range of 0.01% to 1.0% in the assay: PRO200, PRO322, PRO540, PRO846 and PRO617.

Example 111

Rod Photoreceptor Survival (Assay 56)

This assay shows that certain polypeptides of the invention act to enhance the survival/proliferation of rod photoreceptor cells and, therefore, are useful for the therapeutic treatment of retinal disorders or injuries including, for example, treating sight loss in mammals due to retinitis pigmentosum, AMD, etc. Sprague Dawley rat pups at 7 day postnatal (mixed population: glia and retinal neuronal cell types) are killed by decapitation following $CO_2$ anesthesis and the eyes are removed under sterile conditions. The neural retina is dissected away form the pigment epithelium and other ocular tissue and then dissociated into a single cell suspension using 0.25% trypsin in $Ca^{2+}$, $Mg^{2+}$-free PBS. The retinas are incubated at 37° C. for 7–10 minutes after which the trypsin is inactivated by adding 1 ml soybean trypsin inhibitor. The cells are plated at 100,000 cells per well in 96 well plates in DMEM/F12 supplemented with $N_2$. Cells for all experiments are grown at 37° C. in a water saturated atmosphere of 5% $CO_2$. After 2–3 days in culture, cells are fixed using 4% paraformaldehyde, and then stained using CellTracker Green CMFDA. Rho 4D2 (ascites or IgG 1:100), a monoclonal antibody directed towards the visual pigment rhodopsin is used to detect rod photoreceptor cells by indirect immunofluorescence. The results are calculated as % survival: total number of calcein-rhodopsin positive cells at 2–3 days in culture, divided by the total number of rhodopsin positive cells at time 2–3 days in culture. The total cells (fluorescent) are quantified at 20× objective magnification using a CCD camera and NIH image software for MacIntosh. Fields in the well are chosen at random.

The following polypeptides tested positive in this assay: PRO200, PRO322, PRO540, PRO846 and PRO617.

Example 112

Ability of PRO Polypeptides to Stimulate the Release of Proteoglycans from Cartilage (Assay 97)

The ability of various PRO polypeptides to stimulate the release of proteoglycans from cartilage tissue was tested as follows.

The metacarphophalangeal joint of 4–6 month old pigs was aseptically dissected, and articular cartilage was removed by free hand slicing being careful to avoid the underlying bone. The cartilage was minced and cultured in bulk for 24 hours in a humidified atmosphere of 95% air, 5% $CO_2$ in serum free (SF) media (DME/F12 1:1) woth 0.1% BSA and 100 U/ml penicillin and 100 µg/ml streptomycin. After washing three times, approximately 100 mg of articular cartilage was aliquoted into micronics tubes and incubated for an additional 24 hours in the above SF media. PRO polypeptides were then added at 1% either alone or in combination with 18 ng/ml interleukin-1α, a known stimulator of proteoglycan release from cartilage tissue. The supernatant was then harvested and assayed for the amount of proteoglycans using the 1,9-dimethyl-methylene blue (DMB) colorimetric assay (Farndale and Buttle, *Biochem. Biophys. Acta* 883:173–177 (1985)). A positive result in this assay indicates that the test polypeptide will find use, for example, in the treatment of sports-related joint problems, articular cartilage defects, osteoarthritis or rheumatoid arthritis.

When various PRO polypeptides were tested in the above assay, the polypeptides demonstrated a marked ability to stimulate release of proteoglycans from cartilage tissue both basally and after stimulation with interleukin-1α and at 24 and 72 hours after treatment, thereby indicating that these PRO polypeptides are useful for stimulating proteoglycan release from cartilage tissue. As such, these PRO polypeptides are useful for the treatment of sports-related joint problems, articular cartilage defects, osteoarthritis or rheumatoid arthritis. The polypeptides testing positive in this assay are: PRO200.

Example 113

In Vitro Antiproliferative Assay (Assay 161)

The antiproliferative activity of various PRO polypeptides was determined in the investigational, disease-oriented in vitro anti-cancer drug discovery assay of the National Cancer Institute (NCI), using a sulforhodamine B (SRB) dye binding assay essentially as described by Skehan et al., *J. Natl. Cancer Inst.* 82:1107–1112 (1990). The 60 tumor cell lines employed in this study ("the NCI panel"), as well as conditions for their maintenance and culture in vitro have been described by Monks et al., *J. Natl. Cancer Inst.* 83:757–766 (1991). The purpose of this screen is to initially evaluate the cytotoxic and/or cytostatic activity of the test compounds against different types of tumors (Monks et al., supra; Boyd, *Cancer: Princ. Pract. Oncol. Update* 3(10): 1–12 [1989]).

Cells from approximately 60 human tumor cell lines were harvested with trypsin/EDTA (Gibco), washed once, resuspended in IMEM and their viability was determined. The cell suspensions were added by pipet (100 µL volume) into separate 96-well microtiter plates. The cell density for the 6-day incubation was less than for the 2-day incubation to prevent overgrowth. Inoculates were allowed a preincubation period of 24 hours at 37° C. for stabilization. Dilutions at twice the intended test concentration were added at time zero in 100 μL aliquots to the microtiter plate wells (1:2 dilution). Test compounds were evaluated at five half-log dilutions (1000 to 100,000-fold). Incubations took place for two days and six days in a 5% $CO_2$ atmosphere and 100% humidity.

After incubation, the medium was removed and the cells were fixed in 0.1 ml of 10% trichloroacetic acid at 40° C. The plates were rinsed five times with deionized water, dried, stained for 30 minutes with 0.1 ml of 0.4% sulforhodamine B dye (Sigma) dissolved in 1% acetic acid, rinsed four times with 1% acetic acid to remove unbound dye, dried, and the stain was extracted for five minutes with 0.1 ml of 10 mM Tris base [tris(hydroxymethyl)aminomethane], pH 10.5. The absorbance (OD) of sulforhodamine B at 492 nm was measured using a computer-interfaced, 96-well microtiter plate reader.

A test sample is considered positive if it shows at least 50% growth inhibitory effect at one or more concentrations. PRO polypeptides testing positive in this assay are shown in Table 7, where the abbreviations are as follows:

TABLE 7

| Test compound | Tumor Cell Line Type | Cell Line Designation |
| --- | --- | --- |
| PRO181 | Leukemia | RPMI-8226 |
| PRO181 | NSCL | NCI-H226; NCI-H522 |
| PRO181 | Melanoma | MALME-3M; SK-MEL-5 |
| PRO181 | Ovarian | OVCAR-4 |
| PRO181 | Breast | NCI/ADR-RES |
| PRO181 | Leukemia | MOLT-4 |
| PRO181 | NSCL | NCI-H226* |
| PRO181 | CNS | SNB-19 |
| PRO181 | Ovarian | OVCAR-3; OVCAR-8 |
| PRO181 | Renal | A498 |
| PRO181 | Breast | MDA-MB-231/ATCC; MDA-N |
| PRO181 | Melanoma | LOX IMVI |
| PRO181 | Leukemia | CCRF-CEM; RPMI-8226* |
| PRO181 | NSCL | HOP-62 |
| PRO181 | Leukemia | HL-60 (TB) |
| PRO237 | Leukemia | K-562 |
| PRO237 | NSCL | NCI-H322M |
| PRO237 | Colon | HCC-2998; HCT-15 |
| PRO237 | Colon | KM12 |
| PRO237 | Prostate | DU-145 |
| PRO237 | Breast | MDA-N |
| PRO526 | NSCL | HOP-62; NCI-H322M |
| PRO526 | Colon | HCT-116 |
| PRO526 | Melanoma | LOX IMVI; SK-MEL-2 |
| PRO526 | Ovarian | OVCAR-3 |
| PRO526 | Prostate | PC-3 |
| PRO526 | NSCL | NCI-H226 |
| PRO526 | CNS | SF-539 |
| PRO526 | Renal | CAKI-1; RXF 393 |
| PRO362 | NSCL | NCI-H322M |
| PRO362 | Colon | HCT-116 |
| PRO362 | CNS | SF-295 |
| PRO362 | Melanoma | LOX IMVI |
| PRO362 | Leukemia | MOLT-4; RPMI-8226; SR |
| PRO362 | Colon | COLO 205 |
| PRO362 | Breast | HS 578T; MDA-N |
| PRO362 | Prostate | PC-3 |
| PRO362 | Leukemia | HL-60 (TB); K-562 |
| PRO362 | NSCL | EKVX; NCI-H23 |
| PRO362 | Colon | HCC-2998 |
| PRO362 | CNS | U251 |
| PRO362 | Melanoma | UACC-257; UACC-62 |
| PRO362 | Ovarian | OVCAR-8 |
| PRO362 | Breast | T-47D |
| PRO362 | NSCL | NCI-H522 |
| PRO362 | Renal | RXF 393; UO-31 |
| PRO362 | Breast | MDA-MB-435 |

TABLE 7-continued

| Test compound | Tumor Cell Line Type | Cell Line Designation |
| --- | --- | --- |
| PRO362 | NSCL | HOP-62; NCI-H522 |
| PRO362 | Colon | KM12 |
| PRO362 | Melanoma | MALME-3M; SK-MEL-2 |
| PRO362 | Melanoma | SK-MEL-28; SK-MEL-5 |
| PRO362 | Ovarian | OVCAR-3; OVCAR-4 |
| PRO362 | Breast | MCF7 |
| PRO866 | Leukemia | HL-60 (TB); MOLT-4; SR |
| PRO866 | NSCL | HOP-62 |
| PRO866 | NSCL | HOP-92 |
| PRO866 | Colon | KM12 |
| PRO866 | CNS | SF-295 |
| PRO866 | Ovarian | IGROV1 |
| PRO866 | Breast | MDA-MB-435 |
| PRO866 | Melanoma | LOX IMVI |
| PRO320 | Leukemia | CCRF-CEM; RPMI-8226 |
| PRO320 | NSCL | HOP62; NCI H322M |
| PRO320 | Colon | HCT-116 |
| PRO320 | Renal | SN12C |
| PRO320 | Breast | MDA-N |
| PRO320 | Ovarian | OVCAR-3 |
| PRO320 | Melanoma | MALME-3M |

NSCL = non-small cell lung carcinoma
CNS = central nervous system
*cytotoxic

The results of these assays demonstrate that the positive testing PRO polypeptides are useful for inhibiting neoplastic growth in a number of different tumor cell types and may be used therapeutically therefor. Antibodies against these PRO polypeptides are useful for affinity purification of these useful polypeptides. Nucleic acids encoding these PRO polypeptides are useful for the recombinant preparation of these polypeptides.

Example 114

Gene Amplification in Tumors

This example shows that certain PRO polypeptide-encoding genes are amplified in the genome of certain human lung, colon and/or breast cancers and/or cell lines. Amplification is associated with overexpression of the gene product, indicating that the polypeptides are useful targets for therapeutic intervention in certain cancers such as colon, lung, breast and other cancers and diagnostic determination of the presence of those cancers. Therapeutic agents may take the form of antagonists of the PRO polypeptide, for example, murine-human chimeric, humanized or human antibodies against a PRO polypeptide.

The starting material for the screen was genomic DNA isolated from a variety cancers. The DNA is quantitated precisely, e.g., fluorometrically. As a negative control, DNA was isolated from the cells of ten normal healthy individuals which was pooled and used as assay controls for the gene copy in healthy individuals (not shown). The 5' nuclease assay (for example, TaqMan™) and real-time quantitative PCR (for example, ABI Prizm 7700 Sequence Detection System™ (Perkin Elmer, Applied Biosystems Division, Foster City, Calif.)), were used to find genes potentially amplified in certain cancers. The results were used to determine whether the DNA encoding the PRO polypeptide is overrepresented in any of the primary lung or colon cancers or cancer cell lines or breast cancer cell lines that were screened. The primary lung cancers were obtained from individuals with tumors of the type and stage as indicated in Table 8. An explanation of the abbreviations used for the designation of the primary tumors listed in Table 8 and the primary tumors and cell lines referred to throughout this example are given below.

The results of the TaqMan™ are reported in delta (Δ) Ct units. One unit corresponds to 1 PCR cycle or approximately a 2-fold amplification relative to normal, two units corresponds to 4-fold, 3 units to 8-fold amplification and so on. Quantitation was obtained using primers and a TaqMan™ fluorescent probe derived from the PRO polypeptide-encoding gene. Regions of the PRO polypeptide-encoding gene which are most likely to contain unique nucleic acid sequences and which are least likely to have spliced out introns are preferred for the primer and probe derivation, e.g., 3'-untranslated regions. The sequences for the primers and probes (forward, reverse and probe) used for the PRO polypeptide gene amplification analysis were as follows:

```
PRO853 (DNA48227-1350)

48227.tm.f1
5'-GGCACTTCATGGTCCTTGAAA-3'                     (SEQ ID NO:539)

48227.tm.p1
5'-CGGATGTGTGTGAGGCCATGCC-3'                    (SEQ ID NO:540)

48227.tm.r1
5'-GAAAGTAACCACGGAGGTCAAGAT-3'                  (SEQ ID NO:541)

PRO1017 (DNA56112-1379):

56112.tm.f1
5'-CCTCCTCCGAGACTGAAAGCT-3'                     (SEQ ID NO:542)

56112.tm.p1
5'-TCGCGTTGCTTTTTCTCGCGTG-3'                    (SEQ ID NO:543)

56112.tm.r1
5'-GCGTGCGTCAGGTTCCA-3'                         (SEQ ID NO:544)

PRO213-1 (DNA30943-1163-1):

30943.tm.f3:
5'-CGTTCGTGCAGCGTGTGTA-3'                       (SEQ ID NO:545)

30943.tm.p3:
5'-CTTCCTCACCACCTGCGACGGG-3'                    (SEQ ID NO:546)

30943.tm.r3:
5'-GGTAGGCGGTCCTATAGATGGTT-3'                   (SEQ ID NO:547)

30943.tm.f1:
5'-AGATGTGGATGAATGCAGTGCTA-3'                   (SEQ ID NO:548)

30943.tm.p1:
5'-ATCAACACCGCCGGCAGTTACTGG-3'                  (SEQ ID NO:549)

30943.tm.r1:
5'-ACAGAGTGTACCGTCTGCAGACA-3'                   (SEQ ID NO:550)

30943.3trn-5:
5'-AGCCTCCTGGTGCACTCCT-3'                       (SEQ ID NO:551)

30943.3trn-probe:
5'-CGACTCCCTGAGCGAGCAGATTTCC-3'                 (SEQ ID NO:552)

30943.3trn-3:
5'-GCTGGGCAGTCACGAGTCTT-3'                      (SEQ ID NO:553)

PRO237 (DNA34353-1428):

34353.tm.f:
5'-AATCCTCCATCTCAGATCTTCCAG-3'                  (SEQ ID NO:554)

34353.tm.p:
5'-CCTCAGCGGTAACAGCCGGCC-3'                     (SEQ ID NO:555)

34353.tm.r:
5'-TGGGCCAAGGGCTGC-3'                           (SEQ ID NO:556)

PRO324 (DNA36343-1310):

36343.tmf1:
5'-TGGTGGATAACCAACAAGATGG-3'                    (SEQ ID NO:557)

36343.tmp1:
5'-GAGTCTGCATCCACACCACTCTTAAAGTTCTCAA-3'        (SEQ ID NO:558)
```

```
36343.tmr1:
5'-CAGGTGCTCTTTTCAGTCATGTTT-3'          (SEQ ID NO:559)

PRO351 (DNA40571-1315):

40571.tm.f1:
5'-TGGCCATTCTCAGGACAAGAG-3'             (SEQ ID NO:560)

40571.tm.p1:
5'-CAGTAATGCCATTTGCCTGCCTGCAT-3'        (SEQ ID NO:561)

40571.tm.r1:
5'-TGCCTGGAATCACATGACA-3'               (SEQ ID NO:562)

PRO362 (DNA45416-1251):

45416.tm.f1:
5'-TGTGGCACAGACCCAATCCT-3'              (SEQ ID NO:563)

45416.tm.p1:
5'-GACCCTGAAGGCCTCCGGCCT-3'             (SEQ ID NO:564)

45416.tm.r1:
5'-GAGAGAGGGAAGGCAGCTATGTC-3'           (SEQ ID NO:565)

PRO615 (DNA48304-1323):

48304.tm.f1:
5'-CAGCCCCTCTCTTTCACCTGT-3'             (SEQ ID NO:566)

48304.tm.p1:
5'-CCATCCTGTGCAGCTGACACACAGC-3'         (SEQ ID NO:567)

48304.tm.r1:
5'-GC CAGGCTATGA GGCTCCTT-3'            (SEQ ID NO:568)

PRO531 (DNA48314-1320):

48314.tm.f1:
5'-TTCAAGTTCCTGAAGCCGATTAT-3'           (SEQ ID NO:569)

48814.tm.p1:
5'-CCAACTTCCCTCCCCAGTGCCCT-3'           (SEQ ID NO:570)

48814.tm.r1:
5'-TTGGGGAAGGTAGAATTTCCTTGTAT-3'        (SEQ ID NO:571)

PRO618 (DNA49152-1324):

49152.tm.f1:
5'-CCCTTCTGCCTCCCAATTCT-3'              (SEQ ID NO:572)

49152.tm.p1:
5'-TCTCCTCCGTCCCCTTCCTCCACT-3'          (SEQ ID NO:573)

49152.tm.r1:
5'-TGAGCCACTGCCTTGCATTA-3'              (SEQ ID NO:574)

PRO772 (DNA49645-1347):

49645.tm.f2:
5'-TCTGCAGACGCGATGGATAA-3'              (SEQ ID NO:575)

49645.tm.p2:
5'-CCGAAAATAAAACATCGCCCCTTCTGC-3'       (SEQ ID NO:576)

49645.tm.r2:
5'-CACGTGGCCTTTCACACTGA-3'              (SEQ ID NO:577)

49645.tm.f1:
5'-ACTTGTGACAGCAGTATGCTGTCTT-3'         (SEQ ID NO:578)

49645.tm.p1:
5'-AAGCTTCTGTTCAATCCCAGCGGTCC-3'        (SEQ ID NO:579)

49645.tm.r1:
5'-ATGCACAGGCTTTTTCTGGTAA-3'            (SEQ ID NO:580)

PRO703 (DNA50913-1287):
```

-continued

```
50913.tm.f1:
5'-GCAGGAAACCTTCGAATCTGAG-3'            (SEQ ID NO:581)

50913.tm.p1:
5'-ACACCTGAGGCACCTGAGAGAGGAACTCT-3'     (SEQ ID NO:582)

50913.tm.r1:
5'-GACAGCCCAGTACACCTGCAA-3'             (SEQ ID NO:583)
```

PRO792 (DNA56352-1358):

```
56352.tm.f1:
5'-GACGGCTGGATCTGTGAGAAA-3'             (SEQ ID NO:584)

56352.tm.p1:
5'-CACAACTGCTGACCCCGCCCA-3'             (SEQ ID NO:585)

56352.tm.r1:
5'-CCAGGATACGACATGCTGCAA-3'             (SEQ ID NO:586)
```

PRO474 (DNA56045-1380):

```
56045.tm.f1:
5'-AAACTCCAACCTGTATCAGATGCA-3'          (SEQ ID NO:587)

56045.tm.p1:
5'-CCCCCAAGCCCTTAGACTCTAAGCCC-3'        (SEQ ID NO:588)

56045.tm.r1:
5'-GACCCGGCACCTTGCTAAC-3'               (SEQ ID NO:589)
```

PRO274 (DNA39987-1184):

```
39987.tm.f:
5'-GGACGGTCAGTCAGGATGACA-3'             (SEQ ID NO:590)

39987.tm.p:
5'-TTCGGCATCATCTCTTCCCTCTCCC-3'         (SEQ ID NO:591)

39987.tm.r:
5'-ACAAAAAAAGGGAACAAAATACGA-3'          (SEQ ID NO:592)
```

PRO381 (DNA44194-1317)

```
44194.tm.f:
5'-CTTTGAATAGAAGACTTCTGGACAATTT-3'      (SEQ ID NO:593)

44194.tm.p:
5'-TTGCAACTGGGAATATACCACGACATGAGA-3'    (SEQ ID NO:594)

44194.tm.r:
5'-TAGGGTGCTAATTTGTGCTATAACCT-3'        (SEQ ID NO:595)

44194.tm.f2:
5'-GGCTCTGAGTCTCTGCTTGA-3'              (SEQ ID NO:596)

44194.tm.p2:
5'-TCCAACAACCATTTTCCTCTGGTCC-3'         (SEQ ID NO:597)

44194.tm.r2:
5'-AAGCAGTAGCCATTAACAAGTCA-3'           (SEQ ID NO:598)
```

PRO717 (DNA50988-1326):

```
50988.tm.f3:
5'-CAAGCGTCCAGGTTTATTGA-3'              (SEQ ID NO:599)

50988.tm.r3:
5'-GACTACAAGGCGCTCAGCTA-3'              (SEQ ID NO:600)

50988.tm.p3:
5'-CCGGCTGGGTCTCACTCCTCC-3'             (SEQ ID NO:601)
```

PRO1330 and PRO1449 (DNA64907-1163 and DNA64908-1163, respectively):

```
30943.tm.f3:
5'-CGTTCGTGCAGCGTGTGTA-3'               (SEQ ID NO:602)
```

```
-continued
30943.tm.p3:
5'-CTTCCTCACCACCTGCGACG GG-3'           (SEQ ID NO:603)

30943.tm.r3:
5'-GGTAGGCGGTCCTATAGATGGTT-3'           (SEQ ID NO:604)

30943.tm.f1:
5'-AGATG TGGATGAATG CAGTGCTA-3'         (SEQ ID NO:605)

30943.tm.p1:
5'-ATCAACACCGCCGGCAGTTACTGG-3'          (SEQ ID NO:606)

30943.tm.r1:
5'-ACAGAGTGTACCGTCTGCAGACA-3'           (SEQ ID NO:607)

30943.3trn-5:
5'-AGCCTCCTGGTGCACTCCT-3'               (SEQ ID NO:608)

30943.3trn-probe:
5'-CGACTCCCTGAGCGAGCAGATTTCC-3'         (SEQ ID NO:609)

30943.3trn-3:
5'-GCTGGGCAGTCACGAGTCTT-3'              (SEQ ID NO:610)
```

The 5' nuclease assay reaction is a fluorescent PCR-based technique which makes use of the 5' exonuclease activity of Taq DNA polymerase enzyme to monitor amplification in real time. Two oligonucleotide primers (forward [.f] and reverse [.r]) are used to generate an amplicon typical of a PCR reaction. A third oligonucleotide, or probe (.p), is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

The 5' nuclease procedure is run on a real-time quantitative PCR device such as the ABI Prism 7700™ Sequence Detection. The system consists of a thermocycler, laser, charge-coupled device (CCD) camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data.

5' Nuclease assay data are initially expressed as Ct, or the threshold cycle. This is defined as the cycle at which the reporter signal accumulates above the background level of fluorescence. The ΔCt values are used as quantitative measurement of the relative number of starting copies of a particular target sequence in a nucleic acid sample when comparing cancer DNA results to normal human DNA results.

Table 8 describes the stage, T stage and N stage of various primary tumors which were used to screen the PRO polypeptide compounds of the invention.

TABLE 8

Primary Lung and Colon Tumor Profiles

| Primary Tumor Stage | Stage | Other Stage | Dukes Stage | T Stage | N Stage |
|---|---|---|---|---|---|
| Human lung tumor AdenoCa (SRCC724) [LT1] | IIA | | | T1 | N1 |
| Human lung tumor SqCCa (SRCC725) [LT1a] | IIB | | | T3 | N0 |
| Human lung tumor AdenoCa (SRCC726) [LT2] | IB | | | T2 | N0 |
| Human lung tumor AdenoCa (SRCC727) [LT3] | IIIA | | | T1 | N2 |
| Human lung tumor AdenoCa (SRCC728) [LT4] | IB | | | T2 | N0 |
| Human lung tumor SqCCa (SRCC729) [LT6] | IB | | | T2 | N0 |
| Human lung tumor Aden/SqCCa (SRCC730) [LT7] | IA | | | T1 | N0 |
| Human lung tumor AdenoCa (SRCC731) [LT9] | IB | | | T2 | N0 |
| Human lung tumor SqCCa (SRCC732) [LT10] | IIB | | | T2 | N1 |
| Human lung tumor SqCCa (SRCC733) [LT11] | IIA | | | T1 | N1 |
| Human lung tumor AdenoCa (SRCC734) [LT12] | IV | | | T2 | N0 |
| Human lung tumor AdenoSqCCa (SRCC735) [LT13] | IB | | | T2 | N0 |
| Human lung tumor SqCCa (SRCC736) [LT15] | IB | | | T2 | N0 |
| Human lung tumor SqCCa (SRCC737) [LT16] | IB | | | T2 | N0 |
| Human lung tumor SqCCa (SRCC738) [LT17] | IIB | | | T2 | N1 |
| Human lung tumor SqCCa (SRCC739) [LT18] | IB | | | T2 | N0 |
| Human lung tumor SqCCa (SRCC740) [LT19] | IB | | | T2 | N0 |
| Human lung tumor LCCa (SRCC741) [LT21] | IIB | | | T3 | N1 |
| Human lung AdenoCa (SRCC811) [LT22] | 1A | | | T1 | N0 |
| Human colon AdenoCa (SRCC742) [CT2] | | M1 | D | pT4 | N0 |

TABLE 8-continued

Primary Lung and Colon Tumor Profiles

| Primary Tumor Stage | Stage | Other Stage | Dukes Stage | T Stage | N Stage |
|---|---|---|---|---|---|
| Human colon AdenoCa (SRCC743) [CT3] | | | B | pT3 | N0 |
| Human colon AdenoCa (SRCC744) [CT8] | | | B | T3 | N0 |
| Human colon AdenoCa (SRCC745) [CT10] | | | A | pT2 | N0 |
| Human colon AdenoCa (SRCC746) [CT12] | | MO, R1 | B | T3 | N0 |
| Human colon AdenoCa (SRCC747) [CT14] | | pMO, RO | B | pT3 | pN0 |
| Human colon AdenoCa (SRCC748) [CT15] | | M1, R2 | D | T4 | N2 |
| Human colon AdenoCa (SRCC749) [CT16] | | pMO | B | pT3 | pN0 |
| Human colon AdenoCa (SRCC750) [CT17] | | | C1 | pT3 | pN1 |
| Human colon AdenoCa (SRCC751) [CT1] | | MO, R1 | B | pT3 | N0 |
| Human colon AdenoCa (SRCC752) [CT4] | | | B | pT3 | M0 |
| Human colon AdenoCa (SRCC753) [CT5] | | G2 | C1 | pT3 | pN0 |
| Human colon AdenoCa (SRCC754) [CT6] | | pMO, RO | B | pT3 | pN0 |
| Human colon AdenoCa (SRCC755) [CT7] | | G1 | A | pT2 | pN0 |
| Human colon AdenoCa (SRCC756) [CT9] | | G3 | D | pT4 | pN2 |
| Human colon AdenoCa (SRCC757) [CT11] | | | B | T3 | N0 |
| Human colon AdenoCa (SRCC758) [CT18] | | MO, RO | B | pT3 | pN0 |

DNA Preparation:

DNA was prepared from cultured cell lines, primary tumors, normal human blood. The isolation was performed using purification kit, buffer set and protease and all from Quiagen, according to the manufacturer's instructions and the description below.

Cell Culture Lysis:

Cells were washed and trypsinized at a concentration of $7.5 \times 10^8$ per tip and pelleted by centrifuging at 1000 rpm for 5 minutes at 4° C., followed by washing again with ½ volume of PBS recentrifugation. The pellets were washed a third time, the suspended cells collected and washed 2× with PBS. The cells were then suspended into 10 ml PBS. Buffer C1 was equilibrated at 4° C. Qiagen protease #19155 was diluted into 6.25 ml cold ddH$_2$O to a final concentration of 20 mg/ml and equilibrated at 4° C. 10 ml of G2 Buffer was prepared by diluting Qiagen RNAse A stock (100 mg/ml) to a final concentration of 200 μg/ml.

Buffer C1 (10 ml, 4° C.) and ddH2O (40 ml, 4° C.) were then added to the 10 ml of cell suspension, mixed by inverting and incubated on ice for 10 minutes. The cell nuclei were pelleted by centrifuging in a Beckman swinging bucket rotor at 2500 rpm at 4° C. for 15 minutes. The supernatant was discarded and the nuclei were suspended with a vortex into 2 ml Buffer C1 (at 4° C.) and 6 ml ddH$_2$O followed by a second 4° C. centrifugation at 2500 rpm for 15 minutes. The nuclei were then resuspended into the residual buffer using 200 μl per tip. G2 buffer (10 ml) was added to the suspended nuclei while gentle vortexing was applied. Upon completion of buffer addition, vigorous vortexing was applied for 30 seconds. Quiagenprotease (200 μl, prepared as indicated above) was added and incubated at 50° C. for 60 minutes. The incubation and centrifugation was repeated until the lysates were clear (e.g., incubating additional 30–60 minutes, pelleting at 3000×g for 10 min., 4° C.)

Solid Human Tumor Sample Preparation and Lysis:

Tumor samples were weighed and placed into 50 ml conical tubes and held on ice. Processing was limited to no more than 250 mg tissue per preparation (1 tip/preparation). The protease solution was freshly prepared by diluting into 6.25 ml cold ddH$_2$O to a final concentration of 20 mg/ml and stored at 4° C. G2 buffer (20 ml) was prepared by diluting DNAse A to a final concentration of 200 mg/ml (from 100 mg/ml stock). The tumor tissue was homogenated in 19 ml G2 buffer for 60 seconds using the large tip of the polytron in a laminar-flow TC hood in order to avoid inhalation of aerosols, and held at room temperature. Between samples, the polytron was cleaned by spinning at 2×30 seconds each in 2L ddH$_2$O, followed by G2 buffer (50 ml). If tissue was still present on the generator tip, the apparatus was disassembled and cleaned.

Quiagen protease (prepared as indicated above, 1.0 ml) was added, followed by vortexing and incubation at 50° C. for 3 hours. The incubation and centrifugation was repeated until the lysates were clear (e.g., incubating additional 30–60 minutes, pelleting at 3000×g for 10 min., 4° C.).

Human Blood Preparation and Lysis:

Blood was drawn from healthy volunteers using standard infectious agent protocols and citrated into 10 ml samples per tip. Quiagen protease was freshly prepared by dilution into 6.25 ml cold ddH$_2$O to a final concentration of 20 mg/ml and stored at 4° C. G2 buffer was prepared by diluting RNAse A to a final concentration of 200 μg/ml from 100 mg/ml stock. The blood (10 ml) was placed into a 50 ml conical tube and 10 ml C1 buffer and 30 ml ddH$_2$O (both previously equilibrated to 4° C.) were added, and the components mixed by inverting and held on ice for 10 minutes. The nuclei were pelleted with a Beckman swinging bucket rotor at 2500 rpm, 4° C. for 15 minutes and the supernatant discarded. With a vortex, the nuclei were suspended into 2 ml C1 buffer (4° C.) and 6 ml ddH$_2$O (4° C.). Vortexing was repeated until the pellet was white. The nuclei were then suspended into the residual buffer using a 200 μl tip. G2 buffer (10 ml) were added to the suspended nuclei while gently vortexing, followed by vigorous vortexing for 30 seconds. Quiagen protease was added (200 μl) and incubated at 50° C. for 60 minutes. The incubation and centrifugation was repeated until the lysates were clear (e.g., incubating additional 30–60 minutes, pelleting at 3000×g for 10 min., 4° C.).

Purification of Cleared Lysates:

(1) Isolation of Genomic DNA:

Genomic DNA was equilibrated (1 sample per maxi tip preparation) with 10 ml QBT buffer. QF elution buffer was equilibrated at 50° C. The samples were vortexed for 30 seconds, then loaded onto equilibrated tips and drained by gravity. The tips were washed with 2×15 ml QC buffer. The DNA was eluted into 30 ml silanized, autoclaved 30 ml Corex tubes with 15 ml QF buffer (50° C.). Isopropanol (10.5 ml) was added to each sample, the tubes covered with parafin and mixed by repeated inversion until the DNA precipitated. Samples were pelleted by centrifugation in the SS-34 rotor at 15,000 rpm for 10 minutes at 4° C. The pellet location was marked, the supernatant discarded, and 10 ml 70% ethanol (4° C.) was added. Samples were pelleted again by centrifugation on the SS-34 rotor at 10,000 rpm for 10 minutes at 4° C. The pellet location was marked and the supernatant discarded. The tubes were then placed on their side in a drying rack and dried 10 minutes at 37° C., taking care not to overdry the samples.

After drying, the pellets were dissolved into 1.0 ml TE (pH 8.5) and placed at 50° C. for 1–2 hours. Samples were held overnight at 4° C. as dissolution continued. The DNA solution was then transferred to 1.5 ml tubes with a 26 gauge needle on a tuberculin syringe. The transfer was repeated 5× in order to shear the DNA. Samples were then placed at 50° C. for 1–2 hours.

(2) Ouantitation of Genomic DNA and Preparation for Gene Amplification Assay:

The DNA levels in each tube were quantified by standard $A_{260}$, $A_{280}$ spectrophotometry on a 1:20 dilution (5 µl DNA+95 µl ddH$_2$O) using the 0.1 ml quartz cuvetts in the Beckman DU640 spectrophotometer. $A_{260}/A_{280}$ ratios were in the range of 1.8–1.9. Each DNA samples was then diluted further to approximately 200 ng/ml in TE (pH 8.5). If the original material was highly concentrated (about 700 ng/µl), the material was placed at 50° C. for several hours until resuspended.

Fluorometric DNA quantitation was then performed on the diluted material (20–600 ng/ml) using the manufacturer's guidelines as modified below. This was accomplished by allowing a Hoeffer DyNA Quant 200 fluorometer to warm-up for about 15 minutes. The Hoechst dye working solution (#H33258, 10 µl, prepared within 12 hours of use) was diluted into 100 ml 1×TNE buffer. A 2 ml cuvette was filled with the fluorometer solution, placed into the machine, and the machine was zeroed. pGEM 3Zf(+) (2 µl, lot #360851026) was added to 2 ml of fluorometer solution and calibrated at 200 units. An additional 2 µl of pGEM 3Zf(+) DNA was then tested and the reading confirmed at 400+/−10 units. Each sample was then read at least in triplicate. When 3 samples were found to be within 10% of each other, their average was taken and this value was used as the quantification value.

The fluorometricly determined concentration was then used to dilute each sample to 10 ng/µl in ddH$_2$O. This was done simultaneously on all template samples for a single TaqMan plate assay, and with enough material to run 500–1000 assays. The samples were tested in triplicate with Taqman™ primers and probe both B-actin and GAPDH on a single plate with normal human DNA and no-template controls. The diluted samples were used provided that the CT value of normal human DNA subtracted from test DNA was +/−1 Ct. The diluted, lot-qualified genomic DNA was stored in 1.0 ml aliquots at −80° C. Aliquots which were subsequently to be used in the gene amplification assay were stored at 4° C. Each 1 ml aliquot is enough for 8–9 plates or 64 tests Gene Amplification Assay:

The PRO polypeptide compounds of the invention were screened in the following primary tumors and the resulting ΔCt values greater than or equal to 1.0 are reported in Table 9 below.

TABLE 9

ΔCt values in lung and colon primary tumor and cell line models

| Tumor or Cell Line | PRO 213-1 | PRO 237 | PRO 324 | PRO 351 | PRO 362 | PRO 615 | PRO 531 | PRO 853 | PRO 1017 | PRO 618 | PRO 772 | PRO 703 | PRO 792 | PRO 474 | PRO 274 | PRO 381 | PRO 717 | PRO1330 and PRO1449 |
|---|---|---|---|---|---|---|---|---|---|---|---|---|---|---|---|---|---|---|
| LT-1 | 1.60 | — | — | — | — | — | — | — | — | — | — | — | — | — | — | — | — | 1.60 |
| LT-1a | 1.24 | 1.04 | — | — | — | — | 1.70 | — | 1.785 | — | 1.33 | 1.22 | 1.16 | 1.94<br>1.62 | — | — | — | 1.24 |
| LT2 | — | — | — | — | 1.39 | — | — | — | — | — | — | — | — | — | — | — | — | — |
| LT3 | 1.51 | 1.74 | — | — | — | 1.31<br>1.55<br>1.44 | 1.95<br>1.24 | — | 2.38 | 1.03 | 1.11 | 1.77 | 1.10 | 2.55<br>1.52 | — | — | — | 1.51 |
| LT4 | 2.26 | — | — | — | 1.00 | — | 1.46 | — | — | — | — | — | — | — | 1.24 | — | — | 2.26 |
| LT6 | 1.56 | 1.16 | — | — | — | 1.00 | 2.07 | — | 2.80 | — | 1.07 | 1.15 | 1.81 | 2.10<br>2.28 | — | — | — | 1.56 |
| LT7 | 2.45 | 1.44 | — | — | — | 1.09<br>1.03 | — | — | 1.12 | — | — | 1.44 | — | 1.06 | — | — | — | 2.45 |
| LT9 | 1.24 | — | — | 1.19 | — | 1.04<br>1.14 | 1.10 | — | 2.74 | 1.39<br>1.11 | 1.62 | — | 1.99 | 2.56<br>2.59 | — | — | — | 1.24 |
| LT10 | — | 1.20 | — | 1.06 | 1.69 | 1.18<br>1.11 | 1.96<br>1.16 | — | 3.52 | 1.29<br>1.29 | 1.46 | 1.48 | 2.00 | 2.63<br>2.85 | — | — | — | — |
| LT11 | 2.26<br>2.85<br>2.25<br>1.79 | — | 1.34 | 1.02 | — | 1.46<br>1.72<br>1.27<br>1.25<br>1.06 | 1.79 | 1.03 | 1.54<br>2.94<br>1.41 | 1.84 | 1.45 | 1.90<br>1.83 | 1.20 | 1.36<br>5.21 | — | — | — | 2.26<br>2.85<br>2.25<br>1.79 |
| LT12 | 1.86<br>4.32<br>2.59<br>1.55 | — | 1.92 | — | — | 2.08<br>1.87<br>1.41<br>1.50<br>1.25 | 1.86 | 1.18 | 1.77<br>3.02<br>1.82 | — | — | 1.38<br>1.62 | — | 1.64<br>5.01 | — | — | — | 1.86<br>4.32<br>2.59<br>1.55 |
| LT13 | 1.98<br>2.52<br>2.38 | 1.05 | — | 1.23 | — | 1.39<br>1.09<br>1.03 | 2.53<br>2.06<br>1.31 | 1.33 | 1.55<br>2.14<br>2.03 | — | 1.18 | 1.33<br>1.20 | 1.33 | 1.03<br>1.00<br>4.54<br>1.14<br>1.65 | — | — | 7.03 | 1.98<br>2.52<br>2.38 |
| LT15 | 1.40 | — | — | 1.14 | — | 1.67 | 2.56 | 1.28 | 2.23 | — | 1.47 | 1.45 | 1.04 | 1.35 | — | — | 2.71 | 1.40 |

TABLE 9-continued

ΔCt values in lung and colon primary tumor and cell line models

| Tumor or Cell Line | PRO 213-1 | PRO 237 | PRO 324 | PRO 351 | PRO 362 | PRO 615 | PRO 531 | PRO 853 | PRO 1017 | PRO 618 | PRO 772 | PRO 703 | PRO 792 | PRO 474 | PRO 274 | PRO 381 | PRO 717 | PRO1330 and PRO1449 |
|---|---|---|---|---|---|---|---|---|---|---|---|---|---|---|---|---|---|---|
|  | 1.58 |  |  |  |  | 1.47 | 2.95 |  | 2.01 |  |  | 1.44 |  | 1.86 |  |  |  | 1.58 |
|  | 2.69 |  |  |  |  | 1.09 | 1.31 |  | 2.50 |  |  |  |  | 4.97 |  |  |  | 2.69 |
|  |  |  |  |  |  | 1.05 |  |  |  |  |  |  |  | 1.52 |  |  |  |  |
| LT16 | 1.22 | 1.22 | 1.63 | 1.09 | — | 1.32 | — | 1.33 | 2.98 | — | — | 1.07 | — | 4.23 | 1.00 | — | 5.48 | 1.22 |
|  | 2.77 |  |  |  |  | 1.38 |  |  | 1.77 |  |  |  |  | 1.52 |  |  |  | 2.77 |
|  | 1.75 |  |  |  |  |  |  |  |  |  |  |  |  | 1.17 |  |  |  | 1.75 |
| LT17 | 4.58 | 1.07 | 1.75 | 1.46 | — | 1.66 | 1.12 | 1.21 | 2.90 | 1.04 | 1.42 | 1.24 | 1.35 | 1.40 | — | — | — | 4.58 |
|  | 3.73 |  |  |  |  | 1.59 | 1.53 |  | 1.62 |  |  | 1.61 | 1.115 | 5.45 |  |  |  | 3.73 |
|  | 5.55 |  |  |  |  | 1.21 |  |  |  |  |  |  |  |  |  |  |  | 5.55 |
|  |  |  |  |  |  | 1.50 |  |  |  |  |  |  |  |  |  |  |  |  |
|  |  |  |  |  |  | 1.13 |  |  |  |  |  |  |  |  |  |  |  |  |
| LT18 | — | — | — | 1.07 | — | — | — | — | 3.28 | — | — | — | — | 5.31 | 1.61 | — | — | — |
|  |  |  |  |  |  |  |  |  | 1.68 |  |  |  |  |  |  |  |  |  |
| LT19 | 1.03 | — | 1.90 | 1.33 | — | 1.59 | 2.08 | — | 2.54 | — | 1.60 | 1.38 | 1.62 | 1.59 | — | — | — | 1.03 |
|  | 1.22 |  |  |  |  | 1.50 | 2.95 |  | 2.98 |  |  | 1.19 |  | 1.84 |  |  |  | 1.22 |
|  | 1.26 |  |  |  |  | 1.03 |  |  | 1.21 |  |  |  |  | 4.84 |  |  |  | 1.26 |
|  |  |  |  |  |  | 1.48 |  |  |  |  |  |  |  |  |  |  |  |  |
| LT21 | 1.86 | — | 1.15 | 1.27 | — | 1.19 | — | — | 3.14 | — | — | 1.22 | — | 5.15 | — | — | — | 1.86 |
|  | 1.83 |  |  |  |  | 1.09 |  |  |  |  |  |  |  |  |  |  |  | 1.83 |
|  | 3.21 |  |  |  |  | 1.06 |  |  |  |  |  |  |  |  |  |  |  | 3.21 |
| LT22 | 1.61 | — | — | — | — | — | — | — | — | — | — | — | — | — | — | — | — | 1.61 |
| CT2 | 1.61 | — | — | — | — | 1.36 | 2.21 | 2.4 | 3.72 | — | — | 2.10 | 1.46 | 2.67 | — | — | — | 1.61 |
|  | 2.11 |  |  |  |  | 1.25 | 2.55 |  | 2.55 |  |  |  |  | 1.65 |  |  |  | 2.11 |
|  |  |  |  |  |  |  | 1.90 |  |  |  |  |  |  | 1.48 |  |  |  |  |
| CT3 | — | — | — | — | — | 1.12 | 1.50 | 1.52 | 3.91 | — | — | 1.62 | — | 2.41 | — | — | — | — |
|  |  |  |  |  |  |  | 1.58 |  |  |  |  |  |  | 1.02 |  |  |  |  |
| CT8 | 2.80 | — | — | — | — | — | 1.15 | 1.55 | 2.66 | — | — | 1.06 | — | 2.34 | — | — | — | 2.80 |
|  |  |  |  |  |  |  | 1.34 |  |  |  |  |  |  |  |  |  |  |  |
| CT10 | 2.39 | — | — | — | — | 1.55 | 1.75 | 1.97 | 3.57 | — | — | 1.96 | — | 2.23 | — | — | — | 2.39 |
|  |  |  |  |  |  |  | 1.47 |  | 1.78 |  |  |  |  | 1.21 |  |  |  |  |
| CT12 | 3.45 | — | — | — | — | 1.08 | 1.93 | 1.36 | 3.50 | — | — | 1.57 | — | 2.46 | — | — | — | 3.45 |
|  |  |  |  |  |  |  | 1.30 |  | 1.08 |  |  |  |  |  |  |  |  |  |
| CT14 | 3.79 | — | — | — | — | 1.76 | 1.47 | 1.75 | 3.88 | — | — | 1.19 | — | 2.83 | — | — | — | 3.79 |
|  |  |  |  |  |  | 1.02 | 1.11 |  | 1.86 |  |  |  |  |  |  |  |  |  |
| CT15 | 3.66 | — | — | — | — | 1.23 | 2.44 | 1.75 | 3.62 | — | — | 1.70 | — | 2.89 | — | — | 2.61 | 3.66 |
|  |  |  |  |  |  |  | 1.33 |  |  |  |  |  |  |  |  |  |  |  |
| CT16 | 2.66 | — | — | — | — | 1.29 | 1.95 | 1.11 | 3.12 | — | — | 1.51 | — | 2.60 | — | — | 2.21 | 2.66 |
| CT17 | 3.63 | — | — | — | — | 1.44 | 2.19 | 1.11 | 3.34 | — | — | 1.31 | — | 2.33 | — | — | 3.31 | 3.63 |
| CT1 | — | — | — | — | —° | — | — | 1.09 | — | — | — | 1.08 | — | 1.00 | — | — | — | — |
| CT4 | 1.18 | — | — | — | — | 1.17 | — | 1.16 | 1.11 | — | — | 1.63 | — | 1.13 | — | — | — | 1.18 |
|  |  |  |  |  |  | 1.07 |  |  |  |  |  |  |  |  |  |  |  |  |
| CT5 | 1.25 | — | — | — | — | 1.12 | 1.59 | 1.95 | 2.21 | — | — | 1.50 | — | 1.84 | — | — | — | 1.25 |
|  |  |  |  |  |  | 1.16 | 1.35 |  |  |  |  |  |  | 2.05 |  |  |  |  |
|  |  |  |  |  |  |  | 2.11 |  |  |  |  |  |  |  |  |  |  |  |
| CT6 | 1.27 | — | — | — | — | — | — | — | 1.12 | — | — | 1.38 | — | 1.24 | — | — | — | 1.27 |
|  |  |  |  |  |  |  |  |  |  |  |  |  |  | 1.36 |  |  |  |  |
| CT7 | — | — | — | — | — | — | — | 1.14 | — | — | — | 1.50 | — | — | — | — | — | — |
| CT9 | — | — | — | — | — | — | 1.28 | — | 1.29 | — | — | — | — | — | — | — | — | — |
| CT11 | — | — | — | — | — | 1.74 | 1.49 | 1.88 | 1.48 | — | — | 1.99 | — | 2.11 | — | — | — | — |
|  |  |  |  |  |  | 1.17 |  |  |  |  |  |  |  | 2.13 |  |  |  |  |
| CT18 | — | — | — | — | — | 1.36 | — | — | — | — | — | 1.15 | — | 9.66 | — | — | — | — |
| Calu-1 | 1.35 | — | — | — | — | — | — | — | — | — | — | — | — | — | — | — | 1.77 | 1.35 |
|  | 2.95 |  |  |  |  |  |  |  |  |  |  |  |  |  |  |  |  | 2.95 |
| H441 | 2.00 | — | — | — | — | — | — | 1.71 | — | — | — | — | — | — | — | — | 2.57 | 2.00 |
| H522 | — | — | — | — | — | — | — | 1.03 | — | — | — | — | — | — | — | — | 3.78 | — |
| H810 | 2.76 | — | — | — | — | — | — | — | — | — | — | — | — | — | — | — | 1.84 | 2.76 |
| HT29 | 1.31 | — | — | — | — | — | — | — | — | — | — | — | — | — | — | — | 1.71 | 1.31 |
| SW403 | 2.08 | — | — | — | — | — | — | — | — | — | — | — | — | — | — | — | 2.09 | 2.08 |
| LS174T | 1.61 | — | — | — | — | — | — | — | — | — | — | — | — | — | — | — | 2.90 | 1.61 |
| HCT15 | 1.22 | — | — | — | — | — | — | — | — | — | — | — | — | — | — | — | 1.46 | 1.22 |
| HCC2998 | 1.73 | — | — | — | — | — | — | — | — | — | — | — | — | — | — | — | 1.20 | 1.73 |
| HF-000643 | — | — | — | — | — | — | — | — | — | — | — | — | — | — | — | 4.83 | — | — |
| HF-000840 | — | — | — | — | — | — | — | — | — | — | — | — | — | — | — | 1.08 | — | — |
| HF-000811 | — | — | — | — | — | — | — | — | — | — | — | — | — | — | — | 2.09 | — | — |
|  |  |  |  |  |  |  |  |  |  |  |  |  |  |  |  | 3.15 |  |  |
| HF-001294 | — | — | — | — | — | — | — | — | — | — | — | — | — | — | — | 1.14 | — | — |
|  |  |  |  |  |  |  |  |  |  |  |  |  |  |  |  | 1.08 |  |  |
| HF-001296 | — | — | — | — | — | — | — | — | — | — | — | — | — | — | — | 3.18 | — | — |
|  |  |  |  |  |  |  |  |  |  |  |  |  |  |  |  | 3.53 |  |  |
| HF-001291 | — | — | — | — | — | — | — | — | — | — | — | — | — | — | — | 1.17 | — | — |

TABLE 9-continued

ΔCt values in lung and colon primary tumor and cell line models

| Tumor or Cell Line | PRO 213-1 | PRO 237 | PRO 324 | PRO 351 | PRO 362 | PRO 615 | PRO 531 | PRO 853 | PRO 1017 | PRO 618 | PRO 772 | PRO 703 | PRO 792 | PRO 474 | PRO 274 | PRO 381 | PRO 717 | PRO1330 and PRO1449 |
|---|---|---|---|---|---|---|---|---|---|---|---|---|---|---|---|---|---|---|
| A549 | — | — | — | — | — | — | — | — | — | — | — | — | — | — | — | — | 1.66 | — |
| H460 | — | — | — | — | — | — | — | — | — | — | — | — | — | — | — | — | 2.50 | — |
| SKMES1 | — | — | — | — | — | — | — | — | — | — | — | — | — | — | — | — | 2.15 | — |
| SW620 | — | — | — | — | — | — | — | — | — | — | — | — | — | — | — | — | 2.36 | — |
| Colo320 | — | — | — | — | — | — | — | — | — | — | — | — | — | — | — | — | 1.99 | 2.73 |
| HCT116 | — | — | — | — | — | — | — | — | — | — | — | — | — | — | — | — | 1.90 | — |
| SKCO1 | — | — | — | — | — | — | — | — | — | — | — | — | — | — | — | — | 3.13 | — |
| Colo205 | — | — | — | — | — | — | — | — | — | — | — | — | — | — | — | — | 1.48 | — |
| KM12 | — | — | — | — | — | — | — | — | — | — | — | — | — | — | — | — | 1.67 | — |

Summary

Because amplification of the various DNA's as described above occurs in various tumors, it is likely associated with tumor formation and/or growth. As a result, antagonists (e.g., antibodies) directed against these polypeptides would be expected to be useful in cancer therapy.

Example 115

Induction of c-fos in Endothelial Cells (Assay 34)

This assay is designed to determine whether PRO polypeptides show the ability to induce c-fos in endothelial cells. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Human venous umbilical vein endothelial cells (HUVEC, Cell Systems) in growth media (50% Ham's F12 w/o GHT: low glucose, and 50% DMEM without glycine: with $NaHCO_3$, 1% glutamine, 10 mM HEPES, 10% FBS, 10 ng/ml bFGF) were plated on 96-well microtiter plates at a cell density of $1 \times 10^4$ cells/well. The day after plating, the cells were starved by removing the growth media and treating the cells with 100 μl/well test samples and controls (positive control=growth media; negative control=Protein 32 buffer=10 mM HEPES, 140 mM NaCl, 4% (w/v) mannitol, pH 6.8). The cells were incubated for 30 minutes at 37° C., in 5% $CO_2$. The samples were removed, and the first part of the bDNA kit protocol (Chiron Diagnostics, cat. #6005-037) was followed, where each capitalized reagent/buffer listed below was available from the kit.

Briefly, the amounts of the TM Lysis Buffer and Probes needed for the tests were calculated based on information provided by the manufacturer. The appropriate amounts of thawed Probes were added to the TM Lysis Buffer. The Capture Hybridization Buffer was warmed to room temperature. The bDNA strips were set up in the metal strip holders, and 100 μl of Capture Hybridization Buffer was added to each b-DNA well needed, followed by incubation for at least 30 minutes. The test plates with the cells were removed from the incubator, and the media was gently removed using the vacuum manifold. 100 μl of Lysis Hybridization Buffer with Probes were quickly pipetted into each well of the microtiter plates. The plates were then incubated at 55° C. for 15 minutes. Upon removal from the incubator, the plates were placed on the vortex mixer with the microtiter adapter head and vortexed on the #2 setting for one minute. 80 μl of the lysate was removed and added to the bDNA wells containing the Capture Hybridization Buffer, and pipetted up and down to mix. The plates were incubated at 53° C. for at least 16 hours.

On the next day, the second part of the bDNA kit protocol was followed. Specifically, the plates were removed from the incubator and placed on the bench to cool for 10 minutes. The volumes of additions needed were calculated based upon information provided by the manufacturer. An Amplifier Working Solution was prepared by making a 1:100 dilution of the Amplifier Concentrate (20 fm/μl) in AL Hybridization Buffer. The hybridization mixture was removed from the plates and washed twice with Wash A. 50 μl of Amplifier Working Solution was added to each well and the wells were incubated at 53° C. for 30 minutes. The plates were then removed from the incubator and allowed to cool for 10 minutes. The Label Probe Working Solution was prepared by making a 1:100 dilution of Label Concentrate (40 pmoles/μl) in AL Hybridization Buffer. After the 10-minute cool-down period, the amplifier hybridization mixture was removed and the plates were washed twice with Wash A. 50 μl of Label Probe Working Solution was added to each well and the wells were incubated at 53° C. for 15 minutes. After cooling for 10 minutes, the Substrate was warmed to room temperature. Upon addition of 3 μl of Substrate Enhancer to each ml of Substrate needed for the assay, the plates were allowed to cool for 10 minutes, the label hybridization mixture was removed, and the plates were washed twice with Wash A and three times with Wash D. 50 μl of the Substrate Solution with Enhancer was added to each well. The plates were incubated for 30 minutes at 37° C. and RLU was read in an appropriate luminometer.

The replicates were averaged and the coefficient of variation was determined. The measure of activity of the fold increase over the negative control (Protein 32/HEPES buffer described above) value was indicated by chemiluminescence units (RLU). The results are considered positive if the PRO polypeptide exhibits at least a two-fold value over the negative buffer control. Negative control=1.00 RLU at 1.00% dilution. Positive control=8.39 RLU at 1.00% dilution.

The following PRO polypeptides tested positive in this assay: PRO938, PRO200, PRO865, PRO788 and PRO1013.

Example 116

Proliferation of Rat Utricular Supporting Cells (Assay 54)

This assay shows that certain polypeptides of the invention act as potent mitogens for inner ear supporting cells which are auditory hair cell progenitors and, therefore, are useful for inducing the regeneration of auditory hair cells and treating hearing loss in mammals. The assay is performed as follows. Rat UEC-4 utricular epithelial cells are aliquoted into 96 well plates with a density of 3000 cells/well in 200 µl of serum-containing medium at 33° C. The cells are cultured overnight and are then switched to serum-free medium at 37° C. Various dilutions of PRO polypeptides (or nothing for a control) are then added to the cultures and the cells are incubated for 24 hours. After the 24 hour incubation, $^3$H-thymidine (1 µCi/well) is added and the cells are then cultured for an additional 24 hours. The cultures are then washed to remove unincorporated radiolabel, the cells harvested and Cpm per well determined. Cpm of at least 30% or greater in the PRO polypeptide treated cultures as compared to the control cultures is considered a positive in the assay.

The following polypeptide tested positive in this assay: PRO337, PRO363 and PRO1012.

Example 117

Detection of PRO Polypeptides that Affect Glucose or FFA Uptake by Primary Rat Adipocytes (Assay 94)

This assay is designed to determine whether PRO polypeptides show the ability to affect glucose or FFA uptake by adipocyte cells. PRO polypeptides testing positive in this assay would be expected to be useful for the therapeutic treatment of disorders where either the stimulation or inhibition of glucose uptake by adipocytes would be beneficial including, for example, obesity, diabetes or hyper- or hypo-insulinemia.

In a 96 well format, PRO polypeptides to be assayed are added to primary rat adipocytes, and allowed to incubate overnight. Samples are taken at 4 and 16 hours and assayed for glycerol, glucose and FFA uptake. After the 16 hour incubation, insulin is added to the media and allowed to incubate for 4 hours. At this time, a sample is taken and glycerol, glucose and FFA uptake is measured. Media containing insulin without the PRO polypeptide is used as a positive reference control. As the PRO polypeptide being tested may either stimulate or inhibit glucose and FFA uptake, results are scored as positive in the assay if greater than 1.5 times or less than 0.5 times the insulin control.

The following PRO polypeptides tested positive as stimulators of glucose and/or FFA uptake in this assay: PRO181, PRO200, PRO337, PRO362, PRO363, PRO731, PRO534, PRO1114 and PRO1075.

The following PRO polypeptides tested positive as inhibitors of glucose and/or FFA uptake in this assay: PRO195, PRO322, PRO862, PRO868, PRO865 and PRO162.

Example 118

Detection of Polypeptides that Affect Glucose and/or FFA Uptake in Skeletal Muscle (Assay 106)

This assay is designed to determine whether PRO polypeptides show the ability to affect glucose or FFA uptake by skeletal muscle cells. PRO polypeptides testing positive in this assay would be expected to be useful for the therapeutic treatment of disorders where either the stimulation or inhibition of glucose uptake by skeletal muscle would be beneficial including, for example, diabetes or hyper- or hypo-insulinemia.

In a 96 well format, PRO polypeptides to be assayed are added to primary rat differentiated skeletal muscle, and allowed to incubate overnight. Then fresh media with the PRO polypeptide and +/−insulin are added to the wells. The sample media is then monitored to determine glucose and FFA uptake by the skeletal muscle cells. The insulin will stimulate glucose and FFA uptake by the skeletal muscle, and insulin in media without the PRO polypeptide is used as a positive control, and a limit for scoring. As the PRO polypeptide being tested may either stimulate or inhibit glucose and FFA uptake, results are scored as positive in the assay if greater than 1.5 times or less than 0.5 times the insulin control.

The following PRO polypeptides tested positive as either stimulators or inhibitors of glucose and/or FFA uptake in this assay: PRO181, PRO200, PRO1083, PRO865, PRO162, PRO1008 and PRO1330.

Example 119

Stimulation of Heart Neonatal Hypertrophy (Assay 1)

This assay is designed to measure the ability of PRO polypeptides to stimulate hypertrophy of neonatal heart. PRO polypeptides testing positive in this assay are expected to be useful for the therapeutic treatment of various cardiac insufficiency disorders.

Cardiac myocytes from 1-day old Harlan Sprague Dawley rats were obtained. Cells (180 µl at 7.5×10$^4$/ml, serum <0.1%, freshly isolated) are added on day 1 to 96-well plates previously coated with DMEM/F12+4% FCS. Test samples containing the test PRO polypeptide or growth medium only (negative control) (20 µl/well) are added directly to the wells on day 1. PGF (20 µl/well) is then added on day 2 at final concentration of 10$^{-6}$ M. The cells are then stained on day 4 and visually scored on day 5, wherein cells showing no increase in size as compared to negative controls are scored 0.0, cells showing a small to moderate increase in size as compared to negative controls are scored 1.0 and cells showing a large increase in size as compared to negative controls are scored 2.0. A positive result in the assay is a score of 1.0 or greater.

The following polypeptides tested positive in this assay: PRO195, PRO200, PRO526 and PRO792.

Example 120

Enhancement of Heart Neonatal Hypertrophy Induced by F2a (Assay 37)

This assay is designed to measure the ability of PRO polypeptides to stimulate hypertrophy of neonatal heart.

PRO polypeptides testing positive in this assay are expected to be useful for the therapeutic treatment of various cardiac insufficiency disorders.

Cardiac myocytes from 1-day old Harlan Sprague Dawley rats were obtained. Cells (180 µl at $7.5\times10^4$/ml, serum <0.1%, freshly isolated) are added on day 1 to 96-well plates previously coated with DMEM/F12+4% FCS. Test samples containing the test PRO polypeptide (20 µl/well) are added directly to the wells on day 1. PGF (20 µl/well) is then added on day 2 at a final concentration of $10^{-6}$ M. The cells are then stained on day 4 and visually scored on day 5. Visual scores are based on cell size, wherein cells showing no increase in size as compared to negative controls are scored 0.0, cells showing a small to moderate increase in size as compared to negative controls are scored 1.0 and cells showing a large increase in size as compared to negative controls are scored 2.0. A score of 1.0 or greater is considered positive.

No PBS is included, since calcium concentration is critical for assay response. Plates are coated with DMEM/F12 plus 4% FCS (200 µl/well). Assay media included: DMEM/F12 (with 2.44 nm bicarbonate), 10 µg/ml transferrin, 1 µg/ml insulin, 1 µg/ml aprotinin, 2 mmol/L glutamine, 100 U/ml penicillin G, 100 µg/ml streptomycin. Protein buffer containing mannitol (4%) gave a positive signal (score 3.5) at 1/10 (0.4%) and 1/100 (0.04%), but not at 1/1000 (0.004%). Therefore the test sample buffer containing mannitol is not run.

The following PRO polypeptides tested positive in this assay: PRO 195.

Example 121

Guinea Pig Vascular Leak (Assays 32 and 51)

This assay is designed to determine whether PRO polypeptides of the present invention show the ability to induce vascular permeability. Polypeptides testing positive in this assay are expected to be useful for the therapeutic treatment of conditions which would benefit from enhanced vascular permeability including, for example, conditions which may benefit from enhanced local immune system cell infiltration.

Hairless guinea pigs weighing 350 grams or more were anesthetized with Ketamine (75–80 mg/kg) and 5 mg/kg Xylazine intramuscularly. Test samples containing the PRO polypeptide or a physiological buffer without the test polypeptide are injected into skin on the back of the test animals with 100 µl per injection site intradermally. There were approximately 16–24 injection sites per animal. One ml of Evans blue dye (1% in PBS) is then injected intracardially. Skin vascular permeability responses to the compounds (i.e., blemishes at the injection sites of injection) are visually scored by measuring the diameter (in mm) of blue-colored leaks from the site of injection at 1 and 6 hours post administration of the test materials. The mm diameter of blueness at the site of injection is observed and recorded as well as the severity of the vascular leakage. Blemishes of at least 5 mm in diameter are considered positive for the assay when testing purified proteins, being indicative of the ability to induce vascular leakage or permeability. A response greater than 7 mm diameter is considered positive for conditioned media samples. Human VEGF at 0.1 µg/100 µl is used as a positive control, inducing a response of 15–23 mm diameter.

The following PRO polypeptides tested positive in this assay: PRO200.

Example 122

Skin Vascular Permeability Assay (Assay 64)

This assay shows that certain polypeptides of the invention stimulate an immune response and induce inflammation by inducing mononuclear cell, eosinophil and PMN infiltration at the site of injection of the animal. Compounds which stimulate an immune response are useful therapeutically where stimulation of an immune response is beneficial. This skin vascular permeability assay is conducted as follows. Hairless guinea pigs weighing 350 grams or more are anesthetized with ketamine (75–80 mg/Kg) and 5 mg/Kg xylazine intramuscularly (IM). A sample of purified polypeptide of the invention or a conditioned media test sample is injected intradermally onto the backs of the test animals with 100 µl per injection site. It is possible to have about 10–30, preferably about 16–24, injection sites per animal. One µl of Evans blue dye (1% in physiologic buffered saline) is injected intracardially. Blemishes at the injection sites are then measured (mm diameter) at 1 hr and 6 hr post injection. Animals were sacrificed at 6 hrs after injection. Each skin injection site is biopsied and fixed in formalin. The skins are then prepared for histopathologic evaluation. Each site is evaluated for inflammatory cell infiltration into the skin. Sites with visible inflammatory cell inflammation are scored as positive. Inflammatory cells may be neutrophilic, eosinophilic, monocytic or lymphocytic. At least a minimal perivascular infiltrate at the injection site is scored as positive, no infiltrate at the site of injection is scored as negative.

The following polypeptide tested positive in this assay: PRO200, PRO362 and PRO1031.

Example 123

Induction of c-fos in Cortical Neurons (Assay 83)

This assay is designed to determine whether PRO polypeptides show the ability to induce c-fos in cortical neurons. PRO polypeptides testing positive in this assay would be expected to be useful for the therapeutic treatment of nervous system disorders and injuries where neuronal proliferation would be beneficial.

Cortical neurons are dissociated and plated in growth medium at 10,000 cells per well in 96 well plates. After approximately 2 cellular divisions, the cells are treated for 30 minutes with the PRO polypeptide or nothing (negative control). The cells are then fixed for 5 minutes with cold methanol and stained with an antibody directed against phosphorylated CREB. mRNA levels are then calculated using chemiluminescence. A positive in the assay is any factor that results in at least a 2-fold increase in c-fos message as compared to the negative controls.

The following PRO polypeptides tested positive in this assay: PRO200.

Example 124

Mouse Kidney Mesangial Cell Proliferation Assay (Assay 92)

This assay shows that certain polypeptides of the invention act to induce proliferation of mammalian kidney mesangial cells and, therefore, are useful for treating kidney disorders associated with decreased mesangial cell function such as Berger disease or other nephropathies associated with Schönlein-Henoch purpura, celiac disease, dermatitis herpetiformis or Crohn disease. The assay is performed as follows. On day one, mouse kidney mesangial cells are plated on a 96 well plate in growth media (3:1 mixture of Dulbecco's modified Eagle's medium and Ham's F12 medium, 95% fetal bovine serum, 5% supplemented with 14 mM HEPES) and grown overnight. On day 2, PRO polypeptides are diluted at 2 concentrations(1% and 0.1%) in serum-free medium and added to the cells. Control samples are serum-free medium alone. On day 4, 20 µl of the Cell Titer 96 Aqueous one solution reagent (Progema) was added to each well and the colormetric reaction was allowed to proceed for 2 hours. The absorbance (OD) is then measured at 490 nm. A positive in the assay is anything that gives an absorbance reading which is at least 15% above the control reading.

The following polypeptide tested positive in this assay: PRO200, PRO363, PRO731, PRO534, PRO866 and PRO1031.

Example 125

Pericyte c-Fos Induction (Assay 93)

This assay shows that certain polypeptides of the invention act to induce the expression of c-fos in pericyte cells and, therefore, are useful not only as diagnostic markers for particular types of pericyte-associated tumors but also for giving rise to antagonists which would be expected to be useful for the therapeutic treatment of pericyte-associated tumors. Specifically, on day 1, pericytes are received from VEC Technologies and all but 5 ml of media is removed from flask. On day 2, the pericytes are trypsinized, washed, spun and then plated onto 96 well plates. On day 7, the media is removed and the pericytes are treated with 100 µl of PRO polypeptide test samples and controls (positive control=DME+5% serum+/−PDGF at 500 ng/ml; negative control=protein 32). Replicates are averaged and SD/CV are determined. Fold increase over Protein 32 (buffer control) value indicated by chemiluminescence units (RLU) luminometer reading verses frequency is plotted on a histogram. Two-fold above Protein 32 value is considered positive for the assay. ASY Matrix: Growth media=low glucose DMEM=20% FBS+1× pen strep+1× fungizone. Assay Media=low glucose DMEM +5% FBS.

The following polypeptides tested positive in this assay: PRO200.

Example 126

Chondrocyte Re-Differentiation Assay (Assay 110)

This assay shows that certain polypeptides of the invention act to induce redifferentiation of chondrocytes, therefore, are expected to be useful for the treatment of various bone and/or cartilage disorders such as, for example, sports injuries and arthritis. The assay is performed as follows. Porcine chondrocytes are isolated by overnight collagenase digestion of articulary cartilage of metacarpophalangeal joints of 4–6 month old female pigs. The isolated cells are then seeded at 25,000 cells/cm$^2$ in Ham F-12 containing 10% FBS and 4 µg/ml gentamycin. The culture media is changed every third day and the cells are then seeded in 96 well plates at 5,000 cells/well in 100 µl of the same media without serum and 100 µl of the test PRO polypeptide, 5 nM staurosporin (positive control) or medium alone (negative control) is added to give a final volume of 200 µl/well. After 5 days of incubation at 37° C., a picture of each well is taken and the differentiation state of the chondrocytes is determined. A positive result in the assay occurs when the redifferentiation of the chondrocytes is determined to be more similar to the positive control than the negative control.

The following polypeptide tested positive in this assay: PRO200, PRO285, PRO337, PRO526, PRO362, PRO363, PRO531, PRO1083, PRO862, PRO733, PRO1017, PRO792, PRO788, PRO1008, PRO1075, PRO725 and PRO1031.

Example 127

Fetal Hemoglobin Induction in an Erythroblastic Cell Line (Assay 107)

This assay is useful for screening PRO polypeptides for the ability to induce the switch from adult hemoglobin to fetal hemoglobin in an erythroblastic cell line. Molecules testing positive in this assay are expected to be useful for therapeutically treating various mammalian hemoglobin-associated disorders such as the various thalassemias. The assay is performed as follows. Erythroblastic cells are plated in standard growth medium at 1000 cells/well in a 96 well format. PRO polypeptides are added to the growth medium at a concentration of 0.2% or 2% and the cells are incubated for 5 days at 37° C. As a positive control, cells are treated with 100 µM hemin and as a negative control, the cells are untreated. After 5 days, cell lysates are prepared and analyzed for the expression of gamma globin (a fetal marker). A positive in the assay is a gamma globin level at least 2-fold above the negative control.

The following polypeptides tested positive in this assay: PRO237, PRO381, PRO362, PRO724, PRO866, PRO1114, PRO725 and PRO1071.

Example 128

Induction of Pancreatic β-Cell Precursor Proliferation (Assay 117)

This assay shows that certain polypeptides of the invention act to induce an increase in the number of pancreatic β-cell precursor cells and, therefore, are useful for treating various insulin deficient states in mammals, including diabetes mellitus. The assay is performed as follows. The assay uses a primary culture of mouse fetal pancreatic cells and the primary readout is an alteration in the expression of markers that represent either β-cell precursors or mature β-cells. Marker expression is measured by real time quantitative PCR (RTQ-PCR); wherein the marker being evaluated is a transcription factor called Pdx1.

The pancreata are dissected from E14 embryos (CD1 mice). The pancreata are then digested with collagenase/dispase in F12/DMEM at 37° C. for 40 to 60 minutes (collagenase/dispase, 1.37 mg/ml, Boehringer Mannheim, #1097113). The digestion is then neutralized with an equal volume of 5% BSA and the cells are washed once with RPMI1640. At day 1, the cells are seeded into 12-well tissue culture plates (pre-coated with laminin, 20 µg/ml in PBS, Boehringer Mannheim, #124317). Cells from pancreata from 1–2 embryos are distributed per well. The culture medium for this primary culture is 14F /1640. At day 2, the media is removed and the attached cells washed with RPMI/1640. Two mls of minimal media are added in addition to the protein to be tested. At day 4, the media is removed and RNA prepared from the cells and marker expression analyzed by real time quantitative RT-PCR. A protein is considered to be active in the assay if it increases the expression of the relevant β-cell marker as compared to untreated controls.

14F/1640 is RPMI1640 (Gibco) plus the following:
  group A 1:1000
  group B 1:1000
  recombinant human insulin 10 µg/ml
  Aprotinin (50 µg/ml) 1:2000 (Boehringer manheim #981532)
  Bovine pituitary extract (BPE) 60 µg/ml
  Gentamycin 100 ng/ml Group A: (in 10 ml PBS)
  Transferrin, 100 mg (Sigma T2252)
  Epidermal Growth Factor, 100 µg (BRL 100004)
  Triiodothyronine, 10 µl of $5 \times 10^{-6}$ M (Sigma T5516)
  Ethanolamine, 100 µl of $10^{-1}$ M (Sigma E0135)
  Phosphoethalamine, 100 µl of $10^{-1}$ M (Sigma P0503)
  Selenium, 4 µl of $10^{-1}$ M (Aesar #12574)

Group C: (in 10 ml 100% ethanol)
  Hydrocortisone, 2 µl of $5 \times 10^{-3}$ M (Sigma #H0135)
  Progesterone, 100 µl of $1 \times 10^{-3}$ M (Sigma #P6149)
  Forskolin, 500 µl of 20 mM (Calbiochem #344270)

Minimal Media:
  RPMI 1640 plus transferrin (10 µg/ml), insulin(1 µg/ml), gentamycin(100 ng/ml), aprotinin (50 µg/ml) and BPE (15 µg/ml).

Defined Media:
  RPMI 1640 plus transferrin (10 µg/ml), insulin (1 µg/ml), gentamycin (100 ng/ml) and aprotinin (50 µg/ml).

The following polypeptides tested positive in this assay: PRO237 and PRO731.

Example 129

Stimulatory Activity in Mixed Lymphocyte Reaction (MLR) Assay (Assay 24)

This example shows that certain polypeptides of the invention are active as a stimulator of the proliferation of stimulated T-lymphocytes. Compounds which stimulate proliferation of lymphocytes are useful therapeutically where enhancement of an immune response is beneficial. A therapeutic agent may take the form of antagonists of the polypeptide of the invention, for example, murine-human chimeric, humanized or human antibodies against the polypeptide.

The basic protocol for this assay is described in Current Protocols in Immunology, unit 3.12; edited by J E Coligan, A M Kruisbeek, D H Marglies, E M Shevach, W Strober, National Insitutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3 \times 10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:
  100:1 of test sample diluted to 1% or to 0.1%,
  50:1 of irradiated stimulator cells, and
  50:1 of responder PBMC cells.

100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1 \times 10^7$ cells/ml of assay media. The assay is then conducted as described above.

Positive increases over control are considered positive with increases of greater than or equal to 180% being preferred. However, any value greater than control indicates a stimulatory effect for the test protein.

The following PRO polypeptides tested positive in this assay: PRO273, PRO526, PRO381, PRO719, PRO866 and PRO1031.

Example 130

Inhibitory Activity in Mixed Lymphocyte Reaction (MLR) Assay (Assay 67)

This example shows that one or more of the polypeptides of the invention are active as inhibitors of the proliferation of stimulated T-lymphocytes. Compounds which inhibit proliferation of lymphocytes are useful therapeutically where suppression of an immune response is beneficial.

The basic protocol for this assay is described in Current Protocols in Immunology, unit 3.12; edited by J E Coligan, A M Kruisbeek, D H Marglies, E M Shevach, W Strober, National Insitutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3 \times 10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:
  100:1 of test sample diluted to 1% or to 0.1%,
  50:1 of irradiated stimulator cells, and
  50:1 of responder PBMC cells.

100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1 \times 10^7$ cells/ml of assay media. The assay is then conducted as described above.

Any decreases below control is considered to be a positive result for an inhibitory compound, with decreases of less than or equal to 80% being preferred. However, any value less than control indicates an inhibitory effect for the test protein.

The following polypeptide tested positive in this assay: PRO273, PRO526, PRO381, PRO701, PRO363, PRO531, PRO1083, PRO865, PRO788 and PRO1114.

Example 131

Fibroblast (BHK-21) Proliferation (Assay 98)

This assay shows that certain PRO polypeptides of the invention act to induce proliferation of mammalian fibroblast cells in culture and, therefore, function as useful growth factors in mammalian systems. The assay is performed as follows. BHK-21 fibroblast cells plated in standard growth medium at 2500 cells/well in a total volume of 100 µl. The PRO polypeptide, β-FGF (positive control) or nothing (negative control) are then added to the wells in the presence of 1 µg/ml of heparin for a total final volume of 200 µl. The cells are then incubated at 37° C. for 6 to 7 days. After incubation, the media is removed, the cells are washed with PBS and then an acid phosphatase substrate reaction mixture (100 µl/well) is added. The cells are then incubated at 37° C. for 2 hours. 10 µl per well of 1N NaOH is then added to stop the acid phosphatase reaction. The plates are then read at OD 405 nm. A positive in the assay is acid phosphatase activity which is at least 50% above the negative control.

The following PRO polypeptide tested positive in this assay: PRO273 and PRO731.

Example 132

Induction of Endothelial Cell A poptosis (ELISA) (Assay 109)

The ability of PRO polypeptides to induce a poptosis in endothelial cells was tested in human venous umbilical vein endothelial cells (HUVEC, Cell Systems) using a 96-well format, in 0% serum media supplemented with 100 ng/ml VEGF, 0.1% BSA, 1× penn/strep. A positive result in this assay indicates the usefulness of the polypeptide for therapeutically treating any of a variety of conditions associated with undesired endothelial cell growth including, for example, the inhibition of tumor growth. The 96-well plates used were manufactured by Falcon (No. 3072). Coating of 96 well plates were prepared by allowing gelatinization to occur for >30 minutes with 100 µl of 0.2% gelatin in PBS solution. The gelatin mix was aspirated thoroughly before plating HUVEC cells at a final concentration of $2 \times 10^4$ cells/ml in 10% serum containing medium—100 µl volume per well. The cells were grown for 24 hours before adding test samples containing the PRO polypeptide of interest.

To all wells, 100 µl of 0% serum media (Cell Systems) complemented with 100 ng/ml VEGF, 0.1% BSA, 1× penn/strep was added. Test samples containing PRO polypeptides were added in triplicate at dilutions of 1%, 0.33% and 0.11%. Wells without cells were used as a blank and wells with cells only were used as a negative control. As a positive control, 1:3 serial dilutions of 50 µl of a 3× stock of staurosporine were used. The cells were incubated for 24 to 35 hours prior to ELISA.

ELISA was used to determine levels of a poptosis preparing solutions according to the Boehringer Manual [Boehringer, Cell Death Detection ELISA plus, Cat No. 1 920 685]. Sample preparations: 96 well plates were spun down at 1 krpm for 10 minutes (200 g); the supernatant was removed by fast inversion, placing the plate upside down on a paper towel to remove residual liquid. To each well, 200 µl of 1× Lysis buffer was added and incubation allowed at room temperature for 30 minutes without shaking. The plates were spun down for 10 minutes at 1 krpm, and 20 µl of the lysate (cytoplasmic fraction) was transferred into streptavidin coated MTP. 80 µl of immunoreagent mix was added to the 20 µl lystate in each well. The MTP was covered with adhesive foil and incubated at room tempearature for 2 hours by placing it on an orbital shaker (200 rpm). After two hours, the supernatant was removed by suction and the wells rinsed three times with 250 µl of 1× incubation buffer per well (removed by suction). Substrate solution was added (100 µl) into each well and incubated on an orbital shaker at room temperature at 250 rpm until color development was sufficient for a photometric analysis (approx. after 10–20 minutes). A 96 well reader was used to read the plates at 405 nm, reference wavelength, 492 nm. The levels obtained for PIN 32 (control buffer) was set to 100%. Samples with levels >130% were considered positive for induction of a poptosis.

The following PRO polypeptides tested positive in this assay: PRO846.

Example 133

Induction of Endothelial Cell Apoptosis (Assay 73)

The ability of PRO polypeptides to induce a poptosis in endothelial cells was tested in human venous umbilical vein endothelial cells (HUVEC, Cell Systems). A positive test in the assay is indicative of the usefulness of the polypeptide in therapeutically treating tumors as well as vascular disorders where inducing a poptosis of endothelial cells would be beneficial.

The cells were plated on 96-well microtiter plates (Amersham Life Science, cytostar-T scintillating microplate, RPNQ160, sterile, tissue-culture treated, individually wrapped), in 10% serum (CSG-medium, Cell Systems), at a density of $2 \times 10^4$ cells per well in a total volume of 100 µl. On day 2, test samples containing the PRO polypeptide were added in triplicate at dilutions of 1%, 0.33% and 0.11% . Wells without cells were used as a blank and wells with cells only were used as a negative control. As a positive control 1:3 serial dilutions of 50 µl of a 3× stock of staurosporine were used. The ability of the PRO polypeptide to induce a poptosis was determined by processing of the 96 well plates for detection of Annexin V, a member of the calcium and phospholipid binding proteins, to detect apoptosis.

0.2 ml Annexin V—Biotin stock solution (100 µg/ml) was diluted in 4.6 ml 2×$Ca^{2+}$ binding buffer and 2.5% BSA (1:25 dilution). 50 µl of the diluted Annexin V—Biotin solution was added to each well (except controls) to a final concentration of 1.0 µg/ml. The samples were incubated for 10–15 minutes with Annexin-Biotin prior to direct addition of $^{35}$S-Streptavidin. $^{35}$S-Streptavidin was diluted in 2×$Ca^{2+}$ Binding buffer, 2.5% BSA and was added to all wells at a final concentration of 3×$10^4$ cpm/well. The plates were then sealed, centrifuged at 1000 rpm for 15 minutes and placed on orbital shaker for 2 hours. The analysis was performed on a 1450 Microbeta Trilux (Wallac). Percent above background represents the percentage amount of counts per minute above the negative controls. Percents greater than or equal to 30% above background are considered positive.

The following PRO polypeptides tested positive in this assay: PRO719.

Example 134

Human Venous Endothelial Cell Calcium Flux Assay (Assay 68)

This assay is designed to determine whether PRO polypeptides of the present invention show the ability to stimulate calcium flux in human umbilical vein endothelial cells (HUVEC, Cell Systems). Calcium influx is a well documented response upon binding of certain ligands to their receptors. A test compound that results in a positive response in the present calcium influx assay can be said to bind to a specific receptor and activate a biological signaling pathway in human endothelial cells. This could ultimately lead, for example, to endothelial cell division, inhibition of endothelial cell proliferation, endothelial tube formation, cell migration, apoptosis, etc.

Human venous umbilical vein endothelial cells (HUVEC, Cell Systems) in growth media (50:50 without glycine, 1% glutamine, 10 mM Hepes, 10% FBS, 10 ng/ml bFGF), were plated on 96-well microtiter ViewPlates-96 (Packard Instrument Company Part #6005182) microtiter plates at a cell density of 2×$10^4$ cells/well. The day after plating, the cells were washed three times with buffer (HBSS plus 10 mM Hepes), leaving 100 µl/well. Then 100 µl/well of 8 µM Fluo-3 (2×) was added. The cells were incubated for 1.5 hours at 37° C./5% $CO_2$. After incubation, the cells were then washed 3× with buffer (described above) leaving 100 µl/well. Test samples of the PRO polypeptides were prepared on different 96-well plates at 5× concentration in buffer. The positive control corresponded to 50 µM ionomycin (5×); the negative control corresponded to Protein 32. Cell plate and sample plates were run on a FLIPR (Molecular Devices) machine. The FLIPR machine added 25 µl of test sample to the cells, and readings were taken every second for one minute, then every 3 seconds for the next three minutes.

The fluorescence change from baseline to the maximum rise of the curve (Δ change) was calculated, and replicates averaged. The rate of fluorescence increase was monitored, and only those samples which had a Δ change greater than 1000 and a rise within 60 seconds, were considered positive.

The following PRO polypeptides tested positive in the present assay: PRO771.

Example 135

Induction of c-fos in Endothelial Cells (Assay 34)

This assay is designed to determine whether PRO polypeptides show the ability to induce c-fos in endothelial cells. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Human venous umbilical vein endothelial cells (HUVEC, Cell Systems) in growth media (50% Ham's F12 w/o GHT: low glucose, and 50% DMEM without glycine: with NaHCO3, 1% glutamine, 10 mM HEPES, 10% FBS, 10 ng/ml bFGF) were plated on 96-well microtiter plates at a cell density of 1×$10^4$ cells/well. The day after plating, the cells were starved by removing the growth media and treating the cells with 100 µl/well test samples and controls (positive control=growth media; negative control=Protein32 buffer=10 mM HEPES, 140 mM NaCl, 4% (w/v) mannitol, pH 6.8). The cells were incubated for 30 minutes at 37° C., in 5% $CO_2$. The samples were removed, and the first part of the bDNA kit protocol (Chiron Diagnostics, cat. #6005-037) was followed, where each capitalized reagent/buffer listed below was available from the kit.

Briefly, the amounts of the TM Lysis Buffer and Probes needed for the tests were calculated based on information provided by the manufacturer. The appropriate amounts of thawed Probes were added to the TM Lysis Buffer. The Capture Hybridization Buffer was warmed to room temperature. The bDNA strips were set up in the metal strip holders, and 100 µl of Capture Hybridization Buffer was added to each b-DNA well needed, followed by incubation for at least 30 minutes. The test plates with the cells were removed from the incubator, and the media was gently removed using the vacuum manifold. 100 µl of Lysis Hybridization Buffer with Probes were quickly pipetted into each well of the microtiter plates. The plates were then incubated at 55° C. for 15 minutes. Upon removal from the incubator, the plates were placed on the vortex mixer with the microtiter adapter head and vortexed on the #2 setting for one minute. 80 µl of the lysate was removed and added to the bDNA wells containing the Capture Hybridization Buffer, and pipetted up and down to mix. The plates were incubated at 53° C. for at least 16 hours.

On the next day, the second part of the bDNA kit protocol was followed. Specifically, the plates were removed from the incubator and placed on the bench to cool for 10 minutes. The volumes of additions needed were calculated based upon information provided by the manufacturer. An Amplifier Working Solution was prepared by making a 1:100 dilution of the Amplifier Concentrate (20 fm/µl) in AL Hybridization Buffer. The hybridization mixture was removed from the plates and washed twice with Wash A. 50 µl of Amplifier Working Solution was added to each well and the wells were incubated at 53° C. for 30 minutes. The plates were then removed from the incubator and allowed to cool for 10 minutes. The Label Probe Working Solution was prepared by making a 1:100 dilution of Label Concentrate (40 pmoles/µl) in AL Hybridization Buffer. After the 10-minute cool-down period, the amplifier hybridization mixture was removed and the plates were washed twice with Wash A. 50 µl of Label Probe Working Solution was added to each well and the wells were incubated at 53° C. for 15 minutes. After cooling for 10 minutes, the Substrate was warmed to room temperature. Upon addition of 3 µl of Substrate Enhancer to each ml of Substrate needed for the assay, the plates were allowed to cool for 10 minutes, the label hybridization mixture was removed, and the plates were washed twice with Wash A and three times with Wash D. 50 µl of the Substrate Solution with Enhancer was added to each well. The plates were incubated for 30 minutes at 37° C. and RLU was read in an appropriate luminometer.

The replicates were averaged and the coefficient of variation was determined. The measure of activity of the fold increase over the negative control (Protein 32/HEPES buffer described above) value was indicated by chemiluminescence units (RLU). The results are considered positive if the PRO polypeptide exhibits at least a two-fold value over the negative buffer control. Negative control=1.00 RLU at 1.00% dilution. Positive control=8.39 RLU at 1.00% dilution.

The following PRO polypeptides tested positive in this assay: PRO474.

Example 136

Induction of Pancreatic β-Cell Precursor Differentiation (Assay 89)

This assay shows that certain polypeptides of the invention act to induce differentiation of pancreatic β-cell precursor cells into mature pancreatic β-cells and, therefore, are useful for treating various insulin deficient states in mammals, including diabetes mellitus. The assay is performed as follows. The assay uses a primary culture of mouse fetal pancreatic cells and the primary readout is an alteration in the expression of markers that represent either β-cell precursors or mature β-cells. Marker expression is measured by real time quantitative PCR (RTQ-PCR); wherein the marker being evaluated is insulin.

The pancreata are dissected from E14 embryos (CD1 mice). The pancreata are then digested with collagenase/dispase in F12/DMEM at 37° C. for 40 to 60 minutes (collagenase/dispase, 1.37 mg/ml, Boehringer Mannheim, #1097113). The digestion is then neutralized with an equal volume of 5% BSA and the cells are washed once with RPMI1640. At day 1, the cells are seeded into 12-well tissue culture plates (pre-coated with laminin, 20 µg/ml in PBS, Boehringer Mannheim, #124317). Cells from pancreata from 1–2 embryos are distributed per well. The culture medium for this primary culture is 14F/1640. At day 2, the media is removed and the attached cells washed with RPMI/1640. Two mls of minimal media are added in addition to the protein to be tested. At day 4, the media is removed and RNA prepared from the cells and marker expression analyzed by real time quantitative RT-PCR. A protein is considered to be active in the assay if it increases the expression of the relevant β-cell marker as compared to untreated controls.

14F/1640 is RPMI1640 (Gibco) Plus the following:
  group A 1:1000
  group B 1:1000
  recombinant human insulin 10 µg/ml
  Aprotinin (50 µg/ml) 1:2000 (Boehringer manheim #981532)
  Bovine pituitary extract (BPE) 60 µg/ml
  Gentamycin 100 ng/ml Group A: (in 10 ml PBS)
  Transferrin, 100 mg (Sigma T2252)
  Epidermal Growth Factor, 100 µg (BRL 100004)
  Triiodothyronine,10 µl of $5\times10^{-6}$ M (Sigma T5516)
  Ethanolamine, 100 µl of $10^{-1}$ M (Sigma E0135)
  Phosphoethalamine, 100 µl of $10^{-1}$ M (Sigma P0503)
  Selenium, 4 µl of $10^{-1}$ M (Aesar #12574)

Group C: (in 10 ml 100% Ethanol)
  Hydrocortisone, 2 µl of $5\times10^{-3}$ M (Sigma #H0135)
  Progesterone, 100 µl of $1\times10^{-3}$ M (Sigma #P6149)
  Forskolin, 500 µl of 20 mM (Calbiochem #344270)

Minimal Media:
  RPMI 1640 plus transferrin (10 µg/ml), insulin (1 µg/ml), gentamycin(100 ng/ml), aprotinin (50 µg/ml) and BPE (15 µg/ml).

Defined Media:
  RPMI 1640 plus transferrin (10 µg/ml), insulin (1 µg/ml), gentamycin (100 ng/ml) and aprotinin (50 µl/ml).

The following polypeptides were positive in this assay: PRO788 and PRO162.

Example 137

Stimulation of Endothelial Cell Proliferation (Assay 8)

This assay is designed to determine whether PRO polypeptides of the present invention show the ability to stimulate adrenal cortical capillary endothelial cell (ACE) growth. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Bovine adrenal cortical capillary endothelial (ACE) cells (from primary culture, maximum of 12–14 passages) were plated in 96-well plates at 500 cells/well per 100 microliter. Assay media included low glucose DMEM, 10% calf serum, 2 mM glutamine, and 1× penicillin/streptomycin/fungizone. Control wells included the following: (1) no ACE cells added; (2) ACE cells alone; (3) ACE cells plus VEGF (5 ng/ml); and (4) ACE cells plus FGF (5 ng/ml). The control or test sample, (in 100 microliter volumes), was then added to the wells (at dilutions of 1%, 0.1% and 0.01%, respectively). The cell cultures were incubated for 6–7 days at 37°C./5% $CO_2$. After the incubation, the media in the wells was aspirated, and the cells were washed 1× with PBS. An acid phosphatase reaction mixture (100 microliter; 0.1M sodium acetate, pH 5.5, 0.1% Triton X-100, 10 mM p-nitrophenyl phosphate) was then added to each well. After a 2 hour incubation at 37° C., the reaction was stopped by addition of 10 microliters 1N NaOH. Optical density (OD) was measured on a microplate reader at 405 nm.

The activity of a PRO polypeptide was calculated as the fold increase in proliferation (as determined by the acid phosphatase activity, OD 405 nm) relative to (1) cell only background, and (2) relative to maximum stimulation by VEGF. VEGF (at 3–10 ng/ml) and FGF (at 1–5 ng/ml) were employed as an activity reference for maximum stimulation. Results of the assay were considered "positive" if the observed stimulation was ≧50% increase over background.

VEGF (5 ng/ml) control at 1% dilution gave 1.24 fold stimulation; FGF (5 ng/ml) control at 1% dilution gave 1.46 fold stimulation.

The following PRO polypeptides tested positive in this assay: PRO1075.

Example 138

Mouse Mesengial Cell Inhibition Assay (Assay 114)

This assay is designed to determine whether PRO polypeptides of the present invention show the ability to inhibit the proliferation of mouse mesengial cells in culture. PRO polypeptides testing positive in this assay would be expected to be useful for the therapeutic treatment of such diseases or conditions where inhibition of mesengial cell proliferation would be beneficial such as, for example, cystic renal dysplasia, polycystic kidney disease, or other kidney disease assoiciated with abnormal mesengial cell proliferation, renal tumors, and the like.

On day 1, mouse mesengial cells are plated on a 96 well plate in growth medium (a 3:1 mixture of Dulbecco's modified Eagle's medium and Ham's F12 medium, 95%; fetal bovine serum, 5%; supplemented with 14 mM HEPES) and then are allowed to grow overnight. On day 2, the PRO polypeptide is diluted at 2 different concentrations (1%, 0.1%) in serum-free medium and is added to the cells. The negative control is growth medium without added PRO polypeptide. After the cells are allowed to incubate for 48 hours, 20 µl of the Cell Titer 96 Aqueous one solution reagent (Promega) is added to each well and the colormetric reaction is allowed to proceed for 2 hours. The absorbance (OD) is then measured at 490 nm. A positive in the assay is an absorbance reading which is at least 10% above the negative control.

The following PRO polypeptides tested positive in this assay: PRO200 and PRO697.

Example 139

Chondrocyte Proliferation Assay (Assay 111)

This assay is designed to determine whether PRO polypeptides of the present invention show the ability to induce the proliferation and/or redifferentiation of chondrocytes in culture. PRO polypeptides testing positive in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4–6 month old female pigs. The isolated cells are then seeded at 25,000 cells/cm$^2$ in Ham F-12 containing 10% FBS and 4 µg/ml gentamycin. The culture media is changed every third day and the cells are reseeded to 25,000 cells/cm$^2$ every five days. On day 12, the cells are seeded in 96 well plates at 5,000 cells/well in 100 µl of the same media without serum and 100 µl of either serum-free medium (negative control), staurosporin (final concentration of 5 nM; positive control) or the test PRO polypeptide are added to give a final volume of 200 µl/well. After 5 days at 37° C., 20 µl of Alamar blue is added to each well and the plates are incubated for an additional 3 hours at 37° C. The fluorescence is then measured in each well (Ex:530 nm; Em: 590 nm). The fluorescence of a plate containing 200 µl of the serum-free medium is measured to obtain the background. A positive result in the assay is obtained when the fluorescence of the PRO polypeptide treated sample is more like that of the positive control than the negative control.

The following PRO polypeptides tested positive in this assay: PRO181, PRO200 and PRO322.

Example 140

Rat DRG Neuronal Survival Inhibition Assay

This assay is designed to determine whether PRO polypeptides of the present invention show the ability to inhibit the survival of neural cells in culture. Polypeptides testing positive in this assay are expected to be useful for the therapeutic treatment of neuropathic conditions which are associated with undesirable neural cell proliferation including, for example, neuroblastomas, gliomas, glioblastomas, and the like.

A heterogeneous population of neural cells freshly isolated from E14 rat embryo dorsal root ganglia are diluted in complete medium and are plated at 5,000 cells/well on polyurethane pretreated plates containing 50 µl F12 complete media. Test PRO polypeptides (50 µl, one concentration) with 50 µl additional assay media are then added to test for survival inhibition activity. Negative controls are treated with 100 µl of complete medium alone. After 3 days incubation, the cells are stained with CMFDA and fixed after 1 hour with 4% paraformaldehyde. Cells are then quantified by NIH image analysis. A positive in the assay is cell numbers in the treated well(s) being less than 0.5 of the untreated control well(s).

The following PRO polypeptides tested positive in this assay: PRO195 and PRO701.

Example 141

Tissue Expression Distribution

Oligonucleotide probes were constructed from some of the PRO polypeptide-encoding nucleotide sequences shown in the accompanying figures for use in quantitative PCR amplification reactions. The oligonucleotide probes were chosen so as to give an approximately 200–600 base pair amplified fragment from the 3' end of its associated template in a standard PCR reaction. The oligonucleotide probes were employed in standard quantitative PCR amplification reactions with cDNA libraries isolated from different human adult and/or fetal tissue sources and analyzed by agarose gel electrophoresis so as to obtain a quantitative determination of the level of expression of the PRO polypeptide-encoding nucleic acid in the various tissues tested. Knowledge of the expression pattern or the differential expression of the PRO polypeptide-encoding nucleic acid in various different human tissue types provides a diagnostic marker useful for tissue typing, with or without other tissue-specific markers, for determining the primary tissue source of a metastatic tumor, and the like. These assays provided the following results.

| DNA Molecule | Tissues With Significant Expression | Tissues Lacking Significant Expression |
| --- | --- | --- |
| DNA40954-1233 | liver, lung | brain |
| DNA41404-1352 | lung, kidney | liver, retina, pancreas |
| DNA44179-1362 | liver | lung, brain |

-continued

| DNA Molecule | Tissues With Significant Expression | Tissues Lacking Significant Expression |
|---|---|---|
| DNA45234-1277 | kidney | liver, placenta, brain |
| DNA45415-1318 | thyroid, brain, kidney | liver, bone marrow |
| DNA45417-1432 | thyroid, brain, kidney, bone marrow | liver |
| DNA45493-1349 | liver, kidney | brain |
| DNA48306-1291 | brain, kidney | pancreas, liver |
| DNA48328-1355 | thyroid, brain, liver, kidney | bone marrow |
| DNA48329-1290 | brain, bone marrow, kidney | liver, thyroid |
| DNA49624-1279 | placenta | liver, lung, kidney, brain |
| DNA50911-1288 | brain | placenta |
| DNA50914-1289 | brain, kidney, liver | placenta |
| DNA53906-1368 | lung, kidney | brain |
| DNA53912-1457 | lung, liver, kidney, pancreas | brain |
| DNA53977-1371 | lung, liver, kidney, bone marrow | brain, pancreas |
| DNA54002-1367 | bone marrow, liver, kidney | lung, thyroid, brain |
| DNA55737-1345 | bone marrow, kidney | liver, brain |
| DNA57039-1402 | pigment epithelium | lung, brain, liver, kidney |
| DNA57253-1382 | lung, brain, liver, kidney | placenta |
| DNA58747-1384 | lung, brain, kidney, liver | pancreas, thyroid |
| DNA23318-1211 | spleen, brain, heart, colon tumor, prostate | cartilage |
| DNA39975-1210 | brain, colon tumor, heart | THP-1 macrophages |
| DNA39979-1213 | dendrocytes, cartilage, heart | spleen, substantia nigra, uterus, prostate |
| DNA41386-1316 | HUVEC, cartilage, dendrocytes | substantia nigra, colon tumor, uterus |
| DNA50919-1361 | HUVEC, brain, spleen, colon tumor | prostate, cartilage, heart, uterus |
| DNA52185-1370 | dendrocytes | substantia nigra, hippocampus, uterus |
| DNA42663-1154 | uterus, spleen, bone marrow | cartilage, HUVEC, colon tumor |
| DNA50980-1286 | placenta, adrenal gland, prostate | bone marrow, uterus, cartilage |

Example 142

In situ Hybridization

In situ hybridization is a powerful and versatile technique for the detection and localization of nucleic acid sequences within cell or tissue preparations. It may be useful, for example, to identify sites of gene expression, analyze the tissue distribution of transcription, identify and localize viral infection, follow changes in specific mRNA synthesis and aid in chromosome mapping.

In situ hybridization was performed following an optimized version of the protocol by Lu and Gillett, *Cell Vision* 1:169–176 (1994), using PCR-generated $^{33}$P-labeled riboprobes. Briefly, formalin-fixed, paraffin-embedded human tissues were sectioned, deparaffinized, deproteinated inproteinase K (20 g/ml) for 15 minutes at 37° C., and further processed for in situ hybridization as described by Lu and Gillett, supra. A [$^{33}$-P] UTP-labeled antisense riboprobe was generated from a PCR product and hybridized at 55° C. overnight. The slides were dipped in Kodak NTB2 nuclear track emulsion and exposed for 4 weeks.

$^{33}$P-Riboprobe Synthesis 6.0 μl (125 mCi) of $^{33}$P-UTP(Amersham BF 1002, SA<2000 Cimmol) were speedvac dried. To each tube containing dried $^{33}$P-UTP, the following ingredients were added:

2.0 μl 5× transcription buffer
1.0 μl DTT (100 mM)
2.0 μl NTP mix (2.5 mM: 10 μ; each of 10 mM GTP, CTP & ATP+10 μl H$_2$O)
1.0 μl UTP (50 μM)
1.0 μl Rnasin
1.0 μl DNA template (1 μg)
1.0 μl H$_2$O
1.0 μl RNA polymerase (for PCR products T3=AS, T7=S, usually)

The tubes were incubated at 37° C. for one hour. 1.0 μl RQ1 DNase were added, followed by incubation at 37° C. for 15 minutes. 90 μl TE (10 mM Tris pH 7.6/1 mM EDTA pH 8.0) were added, and the mixture was pipetted onto DE81 paper. The remaining solution was loaded in a Microcon-50 ultrafiltration unit, and spun using program 10 (6 minutes). The filtration unit was inverted over a second tube and spun using program 2 (3 minutes). After the final recovery spin, 100 μl TE were added. 1 μl of the final product was pipetted on DE81 paper and counted in 6 ml of Biofluor II.

The probe was run on a TBE/urea gel. 1–3 μl of the probe or 5 μl of RNA Mrk III were added to 3 μl of loading buffer. After heating on a 95° C. heat block for three minutes, the gel was immediately placed on ice. The wells of gel were flushed, the sample loaded, and run at 180–250 volts for 45 minutes. The gel was wrapped in saran wrap and exposed to XAR film with an intensifying screen in −70° C. freezer one hour to overnight.

$^{33}$P-Hybridization

A. Pretreatment of Frozen Sections

The slides were removed from the freezer, placed on aluminium trays and thawed at room temperature for 5 minutes. The trays were placed in 55° C. incubator for five minutes to reduce condensation. The slides were fixed for 10 minutes in 4% paraformaldehyde on ice in the fume hood, and washed in 0.5×SSC for 5 minutes, at room temperature (25 ml 20×SSC+975 ml SQ H$_2$O). After deproteination in 0.5 μg/ml proteinase K for 10 minutes at 37° C. (12.5 μl of 10 mg/ml stock in 250 ml prewarmed RNase-free RNAse buffer), the sections were washed in 0.5×SSC for 10 minutes at room temperature. The sections were dehydrated in 70%, 95%, 100% ethanol, 2 minutes each.

B. Pretreatment of Paraffin-Embedded Sections

The slides were deparaffinized, placed in SQ H$_2$O, and rinsed twice in 2×SSC at room temperature, for 5 minutes each time. The sections were deproteinated in 20 μg/ml proteinase K (500 μl of 10 mg/ml in 250 ml RNase-free RNase buffer; 37° C., 15 minutes)-human embryo, or 8× proteinase K (100 μl in 250 ml Rnase buffer, 37° C., 30 minutes)—formalin tissues. Subsequent rinsing in 0.5×SSC and dehydration were performed as described above.

C. Prehybridization

The slides were laid out in a plastic box lined with Box buffer (4×SSC, 50% formamide)—saturated filter paper. The tissue was covered with 50 μl of hybridization buffer (3.75 g Dextran Sulfate+6 ml SQ H$_2$O), vortexed and heated in the microwave for 2 minutes with the cap loosened. After cooling on ice, 18.75 ml formamide, 3.75 ml 20×SSC and 9 ml SQ H$_2$O were added, the tissue was vortexed well, and incubated at 42° C. for 1–4 hours.

D. Hybridization 1.0×10⁶ cpm probe and 1.0 µl tRNA (50 mg/ml stock) per slide were heated at 95° C. for 3 minutes. The slides were cooled on ice, and 48 µl hybridization buffer were added per slide. After vortexing, 50 µl $^{33}$P mix were added to 50 µl prehybridization on slide. The slides were incubated overnight at 55° C.

E. Washes

Washing was done 2×10 minutes with 2×SSC, EDTA at room temperature (400 ml 20×SSC+16 ml 0.25M EDTA, $V_f$=4 L), followed by RNaseA treatment at 37° C. for 30 minutes (500 µl of 10 mg/ml in 250 ml Rnase buffer=20 µg/ml), The slides were washed 2×10 minutes with 2×SSC, EDTA at room temperature. The stringency wash conditions were as follows: 2 hours at 55° C., 0.1×SSC, EDTA (20 ml 20×SSC+16 ml EDTA, $V_f$=4 L).

F. Oligonucleotides

In situ analysis was performed on a variety of DNA sequences disclosed herein. The oligonucleotides employed for these analyses were derived from the nucleotide sequences disclosed herein and generally range from about 40 to 55 nucleotides in length.

G. Results

In situ analysis was performed on a variety of DNA sequences disclosed herein. The results from these analyses are as follows.

(1) DNA29101-1122 (PRO200)

Fetal: Lower limb expression in developing lower limb bones at the edge of the cartilagenous anlage (i.e. around the outside edge); in developing tendons, in vascular smooth muscle and in cells embracing developing skeletal muscle myocytes and myotubes. Expression also observed at the epiphyseal growth plate. Lymph node expression in marginal sinus of developing lymph nodes. Thymus expression in the subcapsular region of the thymic cortex, possibly representing either the subcapsular epithelial cells or the proliferating, double negative, thymocytes that are found in this region. Spleen is negative. Trachea expression in smooth muscle. Brain (cerebral cortex) focal expression in cortical neurones. Spinal cord negative. Small intestine expression in smooth muscle. Thyroid—generalized expression over thyroid epithelium. Adrenal is negative. Liver expression in ductal plate cells. Stomach expression in mural smooth muscle. Fetal skin expression in basal layer of squamous epithelium. Placenta expression in interstitial cells in trophoblastic villi. Cord expression in wall of arteries and vein.

Comments: Expression pattern suggests that PRO200 may be involved in cell differentiation/proliferation.

High expression was observed at the following additional sites: Chimp ovary—granulosa cells of maturing follicles, lower intensity signal observed over thecal cells. Chimp parathyroid—high expression over chief cells. Human fetal testis—moderate expression over stromal cells surrounding developing tubules. Human fetal lung—high expression over chondrocytes in developing bronchial tree, and low level expression over branching bronchial epithelium. Specific expression was not observed over the renal cell, gastric and colonic carcinomas. Fetal tissues examined (E12–E16 weeks) include: placenta, umbilical cord, liver, kidney, adrenals, thyroid, lungs, heart, great vessels, oesophagus, stomach, small intestine, spleen, thymus, pancreas, brain, eye, spinal cord, body wall, pelvis and lower linb. Adult tissues examined: liver, kidney, adrenal, myocardium, aorta, spleen, lymph node, pancreas, lung, skin, cerebral cortex (rm), hippocampus(rm), cerebellum(rm), penis, eye, bladder, stomach, gastric carcinoma, colon, colonic carcinoma and chondrosarcoma. Acetominophen induced liver injury and hepatic cirrhosis.

(2) DNA30867-1335 (PRO218)

Low level expression over numerous epithelia including fetal small intestine, fetal thyroid, chimp gastric epithelium. Expression also seen over malignant cells in a renal cell carcinoma. Expression in fetal brain, over cortex. The distribution does not suggest an obvious function. Human fetal tissues examined (E12–E16 weeks) include: placenta, umbilical cord, liver, kidney, adrenals, thyroid, lungs, heart, great vessels, oesophagus, stomach, small intestine, spleen, thymus, pancreas, brain, eye, spinal cord, body wall, pelvis and lower limb. Adult human tissues examined: kidney (normal and end-stage), bladder, adrenal, spleen, lymph node, pancreas, lung, skin, eye (inc. retina), colon, bladder, liver (normal, cirrhotic, acute failure), heart, clear cell carcinoma of kidney, gastric adenocarcinoma, colorectal carcinoma. Non-humanprimate tissues examined: Chimp tissues: salivary gland, stomach, thyroid, parathyroid, tongue, thymus, ovary, lymph node, peripheral nerve. Rhesus Monkey tissues: cerebral cortex, hippocampus, cerebellum, penis.

(3) DNA40021-1154 (PRO285)

Low levels of expression observed in the placenta and over hematopoietic cells in the mouse fetal liver. No expression was detected in either human fetal, adult or chimp lymph node and no expression was detected in human fetal or human adult spleen. Fetal tissues examined (E12–E16 weeks) include: placenta, umbilical cord, liver, kidney, adrenals, thyroid, lungs, heart, great vessels, oesophagus, stomach, small intestine, spleen, thymus, pancreas, brain, eye, spinal cord, body wall, pelvis and lower limb. Adult tissues examined: liver, kidney, adrenal, myocardium, aorta, spleen, lymph node, pancreas, lung, skin, cerebral cortex (rm), hippocampus(rm), cerebellum(rm), brain infarct (human), cerebritis (human),penis, eye, bladder, stomach, gastric carcinoma, colon, colonic carcinoma, thyroid (chimp), parathyroid (chimp) ovary (chimp) and chondrosarcoma. Acetominophen induced liver injury and hepatic cirrhosis.

(4) DNA39523-1192 (PRO273)

Expression over epithelium of mouse embryo skin as well as over basal epithelium and dermis of human fetal skin. Basal epithelial pegs of the squamous mucosa of the chimp tongue are also positive. Expression over a subset of cells in developing glomeruli of fetal kidney, adult renal tubules, and over "thyroidized" epithelium in end-stage renal disease, low expression in a renal cell carcinoma, probably over the epithelial cells. Low level expression over stromal cells in fetal lung. Expression over stromal cells in the apical portion of gastric glands. High expression in the lamina propria of the fetal small intestinal villi, normal colonic mucosa and over stromal cells in a colonic carcinoma. Strong expression over benign connective tissue cells in the hylanized stroma of a sarcoma. Expression over stromal cells in the placental villi and the splenic red pulp. In the brain, expression over cortical neurones. Connective tissue surrounding developing bones and over nerve sheath cells in the fetus. Fetal tissues examined (E12–E16 weeks) include: placenta, umbilical cord, liver, kidney, adrenals, thyroid, lungs, heart, great vessels, oesophagus, stomach, small intestine, spleen, thymus, pancreas, brain, eye, spinal cord, body wall, pelvis and lower limb. Adult tissues examined: liver, kidney, adrenal, myocardium, aorta, spleen, lymph node, pancreas, lung, skin, cerebral cortex (rm), hippocampus(rm), eye, stomach, gastric carcinoma, colon, colonic carcinoma, thyroid (chimp), parathyroid (chimp) ovary (chimp) and chondrosarcoma. Acetominophen induced liver injury and hepatic cirrhosis.

Expression was present in many cells in the outer layers (I and II) of the monkey cerebral cortex. A small subset of cells in the deeper cortical layers also expressed mRNA for this chemokine homolog. Scattered cells within the molecular layers of the hippocampus and bordering the inner edge of the dentate gyrus contained chemokine homolog mRNA. No expression was detected within the cerebellar cortex. Chemokine homolog expression is not observed in infarcted brain, where cell death has occurred in the regions where the chemokine homolog normally is expressed. This probe could possibly serve as a marker of a subset of neurons of outer layers of the cerebral cortex and could possibly reveal neuronal migration disorders. Abnormal neuronal migration is a possible cause of some seizure disorders and schizophrenia. In order to gain a better appreciation of the distribution of this mRNA we will test whether the probe will cross-hybridize with mouse brain tissue.

Also shows intriguing and specific patterns of hybridization within postnatal day (P)10 and adult mouse brains. In one sagittal section of P10 mouse brain, strong signal was observed scattered within the molecular layer of the hippocampus and inner edges of the dentate gyrus. Cells in the presubiculum were moderately labeled; the signal extended in a strong band through outer layers of the retrosplenial cortes to the occipital cortex, where the signal dim mished to background levels. A small set of positive neurons were detected in deeper regions of P10 motor cortex; neurons in outer layers of P10 cortex did not exhibit signal above background levels. Moderate hybridization signal was also detected in the inferior colliculus. Chemokine homolog signal in the adult mouse brain was evaluated in three coronal sections at different levels. Strong signal was detected in the septum and in scattered neurons in the pontine nuclei and motor root of the trige mninal nerve; moderate signal was seen in the molecular layers of the hippocampus and outer layers of the retrosplenial cortex.

(5) DNA39979-1213 (PRO296)

Widespread expression in fetal in adult tissues. Expressed in a variety of fetal and adult epithelia, skeletal and cardiac muscle, developing (including retina) and adult CNS, thymic epithelium, placental villi, hepatocytes in cirrhotic and acetaminophen induced toxicity. Highly expressed in hypertrophic chondrocytes in developing skeletal system.The overall expression pattern, while not completely ovelapping (not expressed in glomeruli, more widely expressed in CNS), is not disimilar to VEGF. A possible role in angiogenesis should therefore be considered. Human fetal tissues examined (E12–E16 weeks) include: placenta, umbilical cord, liver, kidney, adrenals, thyroid, lungs, great vessels, stomach, small intestine∝spleen, thymus, pancreas, brain, eye, spinal cord, body wall, pelvis, testis and lower limb. Adult human tissues examined: kidney (normal and end-stage), adrenal, spleen, lymph node, pancreas, lung, eye (inc. retina),bladder, liver (normal, cirrhotic, acute failure). Non-human primate tissues examined: Chimp tissues: adrenal. Rhesus Monkey tissues: cerebral cortex, hippocampus, cerebellum.

(6) DNA52594-1270 (PRO868)

Expression over neuronal cells in fetal dorsal root ganglia, spinal cord, developing enteric neurons, cortical neurons. Low level expression also seen in placental trophoblast. In adult tissues the only site where notable expression was observed was the normal adult prostate; as such it may represent a possible prostate cell surface receptor target antigen. Studies to further characterize the expression in adult tissues seem warranted. Low level expression also observed in a liposarcoma. Fetal tissues examined (E12–E16 weeks) include: placenta, umbilical cord, liver, kidney, adrenals, thyroid, lungs, heart, great vessels, oesophagus, stomach, small intestine, spleen, thymus, pancreas, brain, eye, spinal cord, body wall, pelvis and lower limb. Adult human tissues examined: liver, kidney, adrenal, myocardium, aorta, spleen, lung, skin, chondrosarcoma, eye, stomach, gastric carcinoma, colon, colonic carcinoma, renal cell carcinoma, prostate, bladder mucosa and gall bladder. Acetominophen induced liver injury and hepatic cirrhosis. Rhesus tissues examined: cerebral cortex (rm), hippocampus (rm), cerebellum. Chimp tissues examined: thyroid, parathyroid, ovary, nerve, tongue, thymus, adrenal, gastric mucosa and salivary gland. WIG-1 (WISP-1), WIG-2 (WISP-2) and WIG-5 (WISP-3) expression in human breast carcinoma and normal breast tissue, Wig-2 in lung carcinoma, and Wig-5 in colon carcinoma.

(7) DNA64907-1163 (PRO1330)

In human fetal tissues there was strong specific expression over artrerial, venous, capillary and sinusoidal endothelium in all tissues examined, except for fetal brain. In normal adult tissues expression was low to absent, but when present appeared expression was confined to the vasculature. Highest expression in adult tissues was observed regionally in vessels running within the white matter of rhesus brain—the significance of this pattern is unclear. Elevated expression observed in vasculature of many inflamed and diseased tissues, including tumor vasculature. In some of these tissues it was unclear if expression was soley confined to vascular endothelium. In the 15 lung tumors examined no expression was seen over the malignant epithelium, however, vascular expression was observed in many of the tumors and adjacent lung tissue. Moderate, apparently non-specific background, was seen with this probe over hyalinised collagen and sites of tissue necrosis. In the abscence of a sense control, however, it is not possible to be absolutely certain that all of this signal is non-specific. Some signal, also thought to be non-specific, was seen over the chimp gastric mucosa, transitional cell epithelium of human adult bladder and fetal retina.

(8) DNA49624-1279 (PRO545)

Expression of the ADAM family molecule, ADAM 12 (DNA49624-1279) observed in normal human lung, lung tumor, normal colon and colon carcinoma.

(9) DNA59294-1381 (PRO1031)

The expression of this IL17 homologue was evaluated in a panel consisting of normal adult and fetal tissues and tissues with inflammation, predominantly chronic lymphocytic inflammation. This panel is designed to specifically evaluate the expression pattern in immune mediated inflammatory disease of novel proteins that modulate T lymphocyte function (stimulatory or inhibitory). This protein when expressed as an Ig-fusion protein was immunostimulatory in a dose dependent fashion in the human mnixed lymphocyte reaction (MLR); it caused a 285% and 147% increase above the baseline stimulation index when utilized at two different concentrations (1.0% and 0.1% of a 560 nM stock). Summary: expression was restricted to muscle, certain types of smooth muscle in the adult and in skeletal and smooth muscle in the human fetus. Expression in adult human was in smooth muscle of tubular organs evaluated including colon and gall bladder. There no expression in the smooth muscle of vessels or bronchi. No adult human skeletal muscle was evaluated. In fetal tissues there was moderate to high diffuse expression in skeletal muscle the axial skeleton and limbs. There was weak expression in the smooth muscle of the intestinal wall but no expression in cardiac muscle. Adult human tissues with expression: Colon. there was low level diffuse expression in the smooth muscle (tunica muscularis) in 5 specimens with chronic inflammatory bowel disease. Gall bladder: there was weak to low level expression in the smooth muscle of the gall bladder. Fetal human tissues with expression: there was moderate diffuse expression in skeletal muscle and weak tolow expression in smooth muscle; there was no expression in fetal heart or any other fetal organ including liver, spleen, CNS, kidney, gut, lung. Human tissues with no expression: lung with chronic granulomatous inflammation and chronic bronchitis (5 patients), peripheral nerve, prostate, heart, placenta, liver (disease multiblock), brain (cerbrum and cerebellum), tonsil (reactive hyperplasia), peripheral lymph node, thymus.

(10) DNA45416-1251 (PRO362)

The expression of this novel protein was evaluated in a variety of human and non-human primate tissues and was found to be highly restricted. Expression was present only in alveolar macrophages in the lung and in Kupffer cells of the hepatic sinusoids. Expression in these cells was significantly increased when these distinct cell populations were activated. Though these two subpopulations of tissue macrophages are located in different organs, they have similar biological functions. Both types of these phagocytes act as biological filters to remove material from the blood stream or airways including pathogens, senescent cells and proteins and both are capable of secreting a wide variery of important proinflammatory cytokines. In inflamed lung (7 patient samples) expression was prominent in reactive alveolar macrophage cell populations defined as large, pale often vacuolated cells present singly or in aggregates within alveoli and was weak to negative in normal, non-reactive macrophages (single scattered cells of normal size). Expression in alveolar macrophages was increased during inflammation when these cells were both increased in numbers and size (activated). Despite the presence of histocytes in areas of interstial inflam ntion and peribronchial lymphoid hyperplasia in these tissues, expression was restricted to alveolar macrophages. Many of the inflamed lungs also had some degree of suppurative inflammation; expression was not present in neutrophilic granulocytes. In liver, there was strong expression in reactive/activated Kupffer cells in livers with acute centrilobular necrosis (acetominophen toxicity) or fairly marked periportal inflammtion. However there was weak or no expression in Kupffer cells in normal liver or in liver with only mild inflammation or mild to moderate lobular hyperplasia/hypertrophy. Thus, as in the lung, there was increased expression in acivated/reative cells. There was no expression of this molecule in histiocytes/rnacropahges present in inflamed bowel, hyperplastic/reactive tonsil or normal lymph node. The lack of expression in these tissues which all contained histiocytic inflammation or resident macrophage populations strongly supports restricted expression to the unique macrophage subset populations defined as alveolar macrophage and hepatic Kupffer cells. Spleen or bone marrow was not available for evaluation. Human tissues evaluated which had no detectable expression included: Inflammatory bowel disease (7 patient samples with moderate to severe disease), tonsil with reactive hyperplasia, peripheral lymphnode, psoriatic skin (2 patient samples with mild to moderate disease), heart, peripheral nerve. Chimp tissues evaluated which had no detectable expression included: tongue, stomach, thymus.

(11) DNA52196-1348 (PRO733)

Generalized low level signal in many tissues and in many cell types. While endothelial cell expression was observed it was not a prominent feature in either fetal, normal or diseased tissues. Human tissues: moderate expression over fetal liver (mainly hepatocytes), lung, skin, adrenal and heart. Fetal spleen, small intestine, brain and eye are negative. Adult normal kidney, bladder epithelium, lung, adrenal, pancreas, skin—all negative. Expression in adult human liver (normal and diseased), renal tubules in end-stage renal disease, adipose tissue, sarcoma, colon, renal cell carcinoma, hepatocellular carcinoma, squamous cell carcinoma. Non human primate tissues: chimp salivary gland, vessels, stomach, tongue, peripheral nerve, thymus, lymph node, thyroid and parathyroid. Rhesus spinal cord negative, cortical and hippocampal neurones positive.

Example 143

Isolation of cDNA Clones Encoding a Human PRO4993

A consensus DNA sequence was assembled relative to other EST sequences using phrap as described in Example 1 above. This consensus sequence is herein designated DNA85042. In some cases, the DNA85042 consensus sequence derives from an intermediate consensus DNA sequence which was extended using repeated cycles of BLAST and phrap to extend that intermediate consensus sequence as far as possible using the sources of EST sequences discussed above. Based on the DNA85042 consensus sequence, oligonucleotides were synthesized: 1) to identify by PCR a cDNA library that contained the sequence of interest, and 2) for use as probes to isolate a clone of the full-length coding sequence for PRO4993.

PCR primers (forward and reverse) were synthesized:

```
forward PCR primer
5'-AGATGTGAAGGTGCAGGTGTGCCG-3'    (SEQ ID NO:619)

reverse PCR primer
5'-GAACATCAGCGCTCCCGGTAATTCC-3'   (SEQ ID NO:620)
```

Additionally, a synthetic oligonucleotide hybridization probe was constructed from the consensus DNA85042 sequence which had the following nucleotide sequence

```
hybridization probe                         (SEQ ID NO:621)
5'-CCAGCCTTTGAATGGTACAAAGGAGAGAAGAAGCTCTTCAATGGCC-
3'
```

RNA for construction of the cDNA libraries was isolated from human fetal brain tissue.

DNA sequencing of the clones isolated as described above gave the full-length DNA sequence for a full-length PRO4993 polypeptide (designated herein as DNA94832-2659 [FIG. 229, SEQ ID NO:611]) and the derived protein sequence for that PRO4993 polypeptide.

The full length clone identified above contained a single open reading frame with an apparent translational initiation site at nucleotide positions 305–307 and a stop signal at nucleotide positions 1361–1363 (FIG. 229, SEQ ID NO:611). The predicted polypeptide precursor is 352 amino acids long, has a calculated molecular weight of approximately 38,429 daltons and an estimated pI of approximately 6.84. Analysis of the full-length PRO4993 sequence shown in FIG. 230 (SEQ ID NO:612) evidences the presence of a variety of important polypeptide domains as shown in FIG. 230, wherein the locations given for those important polypeptide domains are approximate as described above. Clone DNA94832-2659 has been deposited with ATCC on Jun. 15, 1999 and is assigned ATCC deposit no. 240-PTA.

An analysis of the Dayhoff database (version 35.45 SwissProt 35), using the ALIGN-2 sequence alignment analysis of the full-length sequence shown in FIG. 230 (SEQ ID NO:612), evidenced sequence identity between the PRO4993 amino acid sequence and the following Dayhoff sequences: P_W05152; LAMP_HUMAN; P_W05157; P_W05155; I56551; OPCM_RAT; AMAL_DROME; DMU78177_1; I37246; and NCA1_HUMAN.

Example 144

Isolation of cDNA Clones Encoding Human PRO1559, PRO725 and PRO739

A consensus sequence was obtained relative to a variety of EST sequences as described in Example 1 above. Based upon an observed homology between this consensus sequence and an EST sequence contained within Incyte EST clone No. 4242090, Incyte EST clone No. 4242090 was purchased and its insert was obtained and sequenced. It was discovered that the insert sequence encoded a full-length protein designated herein as PRO1559 (FIG. 232; SEQ ID NO:614). The DNA sequence of the insert (DNA68886) is shown in FIG. 231 (SEQ ID NO:613).

A cDNA sequence isolated in the amylase screen described in Example 2 above is herein designated DNA43301. The DNA43301 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is herein designated DNA45458. Based on the DNA45458 consensus sequence, oligonucleotide probes were generated and used to screen a human fetal brain (LIB153) library prepared as described in paragraph 1 of Example 2 above. The cloning vector was pRK5B (pRK5B is a precursor of pRK5D that does not contain the SfiI site; see, Holmes et al., *Science* 253:1278–1280 (1991)), and the cDNA size cut was less than 2800 bp.

PCR primers (forward and reverse) were synthesized:

forward PCR primer (45458.f1)
5'-CCAAACTCACCCAGTGAGTGTGAGC-3'  (SEQ ID NO:619)

reverse PCR primer (45458.r1)
5'-TGGGAAATCAGGAATGGTGTTCTCC-3'  (SEQ ID NO:620)

Additionally, a synthetic oligonucleotide hybridization probe was constructed from the consensus DNA45458 sequence which had the following nucleotide sequence hybridization probe (45458.p1)  (SEQ ID NO:621)
5'-CTTGTTTTCACCATTGGGCTAACTTTGCTGCTAGGAGTTCAAGCCATG
CC-3'

In order to screen several libraries for a source of a full-length clone, DNA from the libraries was screened by PCR amplification with the PCR primer pair identified above. A positive library was then used to isolate clones encoding the PRO725 gene using the probe oligonucleotide and one of the PCR primers.

A full length clone was identified that contained a single open reading frame with an apparent translational initiation site at nucleotide positions 161–163 and ending at the stop codon found at nucleotide positions 455–457 (FIG. 233; SEQ ID NO:615). The predicted polypeptide precursor is 98 amino acids long, has a calculated molecular weight of approximately 11,081 daltons and an estimated pI of approximately 6.68. Analysis of the full-length PRO725 sequence shown in FIG. 234 (SEQ ID NO:616) evidences the presence of the following: a signal peptide from about amino acid 1 to about amino acid 20, a potential N-glycosylation site from about amino acid 72 to about amino acid 75 and a tyrosine kinase phosphorylation site from about amino acid 63 to about amino acid 70. Clone DNA52758-1399 has been deposited with ATCC on Apr. 14, 1998 and is assigned ATCC deposit no. 209773.

Analysis of the amino acid sequence of the full-length PRO725 polypeptide suggests that it possesses no significant sequence similarity to any known protein. However, an analysis of the Dayhoff database (version 35.45 SwissProt 35) evidenced some degree of homology between the PRO725 amino acid sequence and the following Dayhoff sequences, POL_BLVAU, PSSP_RAT, CELC36C5_7, AF019234_1, I48862, P_R12498, P_P10125, P_R26861, A64527 and P_W20495.

DNA52756, as shown in FIG. 235 (SEQ ID NO:617) and which encodes native PRO739 polypeptide (FIG. 236; SEQ ID NO:618) was obtained from GenBank.

Example 145

Identification of Receptor/Ligand Interactions

In this assay, various PRO polypeptides are tested for ability to bind to a panel of potential receptor molecules for the purpose of identifying receptor/ligand interactions. The identification of a ligand for a known receptor, a receptor for a known ligand or a novel receptor/ligand pair is useful for a variety of indications including, for example, targeting bioactive molecules (linked to the ligand or receptor) to a cell known to express the receptor or ligand, use of the receptor or ligand as a reagent to detect the presence of the ligand or receptor in a composition suspected of containing the same, wherein the composition may comprise cells suspected of expressing the ligand or receptor, modulating the growth of or another biological or immunological activity of a cell known to express or respond to the receptor or ligand, modulating the immune response of cells or toward cells that express the receptor or ligand, allowing the preparaion of agonists, antagonists and/or antibodies directed against the receptor or ligand which will modulate the growth of or a biological or immunological activity of a cell expressing the receptor or ligand, and various other indications which will be readily apparent to the ordinarily skilled artisan.

The assay is performed as follows. A PRO polypeptide of the present invention suspected of being a ligand for a receptor is expressed as a fusion protein containing the Fc domain of human IgG (an immunoadhesin). Receptor-ligand binding is detected by allowing interaction of the immunoadhesin polypeptide with cells (e.g. Cos cells) expressing candidate PRO polypeptide receptors and visualization of bound immunoadhesin with fluorescent reagents directed toward the Fc fusion domain and examination by microscope. Cells expressing candidate receptors are produced by transient transfection, in parallel, of defined subsets of a library of cDNA expression vectors encoding PRO polypeptides that may function as receptor molecules. Cells are then incubated for 1 hour in the presence of the PRO polypeptide immunoadhesin being tested for possible receptor binding. The cells are then washed and fixed with paraformaldehyde. The cells are then incubated with fluorescent conjugated antibody directed against the Fc portion of the PRO polypeptide immunoadhesin (e.g. FITC conjugated goat anti-human-Fc antibody). The cells are then washed again and examined by microscope. A positive interaction is judged by the presence of fluorescent labeling of cells transfected with cDNA encoding a particular PRO polypeptide receptor or pool of receptors and an absence of similar fluorescent labeling of similarly prepared cells that have been transfected with other cDNA or pools of cDNA. If a defined pool of cDNA expression vectors is judged to be positive for interaction with a PRO polypeptide immunoadhesin, the individual cDNA species that comprise the pool are tested individually (the pool is "broken down") to determine the specific cDNA that encodes a receptor able to interact with the PRO polypeptide immunoadhesin.

In another embodiment of this assay, an epitope-tagged potential ligand PRO polypeptide (e.g. 8 histidine "His" tag) is allowed to interact with a panel of potential receptor PRO polypeptide molecules that have been expressed as fusions with the Fc domain of human IgG (immunoadhesins). Following a 1 hour co-incubation with the epitope tagged PRO polypeptide, the candidate receptors are each immunoprecipitated with protein A beads and the beads are washed. Potential ligand interaction is determined by western blot analysis of the immunoprecipitated complexes with antibody directed towards the epitope tag. An interaction is judged to occur if a band of the anticipated molecular weight of the epitope tagged protein is observed in the western blot analysis with a candidate receptor, but is not observed to occur with the other members of the panel of potential receptors.

Using these assays, the following receptor/ligand interactions have been herein identified: PRO337 binds to PRO4993, PRO1559 binds to PRO725, PRO1559 binds to PRO700 and PRO1559 binds to PRO739.

Deposit of Material

| Material | ATCC Dep. No. | Deposit Date |
|---|---|---|
| DNA39987-1184 | ATCC 209716 | Apr. 21, 1998 |
| DNA40625-1189 | ATCC 209788 | Apr. 21, 1998 |
| DNA23318-1211 | ATCC 209787 | Apr. 21, 1998 |
| DNA39979-1119 | ATCC 209789 | Apr. 21, 1998 |
| DNA40594-1233 | ATCC 209617 | Feb. 5, 1998 |
| DNA45416-1251 | ATCC 209620 | Feb. 5, 1998 |
| DNA45419-1252 | ATCC 209616 | Feb. 5, 1998 |
| DNA52594-1270 | ATCC 209679 | Mar. 17, 1998 |
| DNA45234-1277 | ATCC 209654 | Mar. 5, 1998 |
| DNA49624-1279 | ATCC 209655 | Mar. 5, 1998 |

-continued

| Material | ATCC Dep. No. | Deposit Date |
|---|---|---|
| DNA48309-1280 | ATCC 209656 | Mar. 5, 1998 |
| DNA46776-1284 | ATCC 209721 | Mar. 31, 1998 |
| DNA50980-1286 | ATCC 209717 | Mar. 31, 1998 |
| DNA50913-1287 | ATCC 209716 | Mar. 31, 1998 |
| DNA50914-1289 | ATCC 209722 | Mar. 31, 1998 |
| DNA48296-1292 | ATCC 209668 | Mar. 11, 1998 |
| DNA32284-1307 | ATCC 209905 | Mar. 11, 1998 |
| DNA36343-1310 | ATCC 209718 | Mar. 31, 1998 |
| DNA40571-1315 | ATCC 209784 | Apr. 21, 1998 |
| DNA41386-1316 | ATCC 209703 | Mar. 26, 1998 |
| DNA44194-1317 | ATCC 209808 | Apr. 28, 1998 |
| DNA45415-1318 | ATCC 209810 | Apr. 28, 1998 |
| DNA44189-1322 | ATCC 209699 | Mar. 26, 1998 |
| DNA48304-1323 | ATCC 209811 | Apr. 28, 1998 |
| DNA49152-1324 | ATCC 209813 | Apr. 28, 1998 |
| DNA49646-1327 | ATCC 209705 | Mar. 26, 1998 |
| DNA49631-1328 | ATCC 209806 | Apr. 28, 1998 |
| DNA49645-1347 | ATCC 209809 | Apr. 28, 1998 |
| DNA45493-1349 | ATCC 209805 | Apr. 28, 1998 |
| DNA48227-1350 | ATCC 209812 | Apr. 28, 1998 |
| DNA41404-1352 | ATCC 209844 | May 6, 1998 |
| DNA44196-1353 | ATCC 209847 | May 6, 1998 |
| DNA52187-1354 | ATCC 209845 | May 6, 1998 |
| DNA48328-1355 | ATCC 209843 | May 6, 1998 |
| DNA56352-1358 | ATCC 209846 | May 6, 1998 |
| DNA53971-1359 | ATCC 209750 | Apr. 7, 1998 |
| DNA50919-1361 | ATCC 209848 | May 6, 1998 |
| DNA44179-1362 | ATCC 209851 | May 6, 1998 |
| DNA54002-1367 | ATCC 209754 | Apr. 7, 1998 |
| DNA53906-1368 | ATCC 209747 | Apr. 7, 1998 |
| DNA52185-1370 | ATCC 209861 | May 14, 1998 |
| DNA53977-1371 | ATCC 209862 | May 14, 1998 |
| DNA57253-1382 | ATCC 209867 | May 14, 1998 |
| DNA58847-1383 | ATCC 209879 | May 20, 1998 |
| DNA58747-1384 | ATCC 209868 | May 14, 1998 |
| DNA57689-1385 | ATCC 209869 | May 14, 1998 |
| DNA23330-1390 | ATCC 209775 | Apr. 14, 1998 |
| DNA26847-1395 | ATCC 209772 | Apr. 14, 1998 |
| DNA53974-1401 | ATCC 209774 | Apr. 14, 1998 |
| DNA57039-1402 | ATCC 209777 | Apr. 14, 1998 |
| DNA57033-1403 | ATCC 209905 | May 27, 1998 |
| DNA34353-1428 | ATCC 209855 | May 12, 1998 |
| DNA45417-1432 | ATCC 209910 | May 27, 1998 |
| DNA39523-1192 | ATCC 209424 | Oct. 31, 1997 |
| DNA44205-1285 | ATCC 209720 | Mar. 31, 1998 |
| DNA50911-1288 | ATCC 209714 | Mar. 31, 1998 |
| DNA48329-1290 | ATCC 209785 | Apr. 21, 1998 |
| DNA48306-1291 | ATCC 209911 | May 27, 1998 |
| DNA48336-1309 | ATCC 209669 | Mar. 11, 1998 |
| DNA44184-1319 | ATCC 209704 | Mar. 26, 1998 |
| DNA48314-1320 | ATCC 209702 | Mar. 26, 1998 |
| DNA48333-1321 | ATCC 209701 | Mar. 26, 1998 |
| DNA50920-1325 | ATCC 209700 | Mar. 26, 1998 |
| DNA50988-1326 | ATCC 209814 | Apr. 28, 1998 |
| DNA48331-1329 | ATCC 209715 | Mar. 31, 1998 |
| DNA30867-1335 | ATCC 209807 | Apr. 28, 1998 |
| DNA55737-1345 | ATCC 209753 | Apr. 7, 1998 |
| DNA49829-1346 | ATCC 209749 | Apr. 7, 1998 |
| DNA52196-1348 | ATCC 209748 | Apr. 7, 1998 |
| DNA56965-1356 | ATCC 209842 | May 6, 1998 |
| DNA56405-1357 | ATCC 209849 | May 6, 1998 |
| DNA57530-1375 | ATCC 209880 | May 20, 1998 |
| DNA56439-1376 | ATCC 209864 | May 14, 1998 |
| DNA56409-1377 | ATCC 209882 | May 20, 1998 |
| DNA56112-1379 | ATCC 209883 | May 20, 1998 |
| DNA56045-1380 | ATCC 209865 | May 14, 1998 |
| DNA59294-1381 | ATCC 209866 | May 14, 1998 |
| DNA56433-1406 | ATCC 209857 | May 12, 1998 |
| DNA53912-1457 | ATCC 209870 | May 14, 1998 |
| DNA50921-1458 | ATCC 209859 | May 12, 1998 |
| DNA29101-1122 | ATCC 209653 | Mar. 5, 1998 |
| DNA40021-1154 | ATCC 209389 | Oct. 17, 1997 |
| DNA42663-1154 | ATCC 209386 | Oct. 17, 1997 |
| DNA30943-1-1163-1 | ATCC 209791 | Apr. 21, 1998 |
| DNA64907-1163-1 | ATCC 203242 | Sep. 9, 1998 |
| DNA64908-1163-1 | ATCC 203243 | Sep. 9, 1998 |
| DNA39975-1210 | ATCC 209783 | Apr. 21, 1998 |

-continued

| Material | ATCC Dep. No. | Deposit Date |
|---|---|---|
| DNA43316-1237 | ATCC 209487 | Nov. 21, 1997 |
| DNA55800-1263 | ATCC 209680 | Mar. 17, 1998 |
| DNA94832-2659 | 240-PTA | Jun. 15, 1999 |
| DNA52758-1399 | ATCC 209773 | Apr. 14, 1998 |

These deposit were made under the provisions of the Budapest Treaty on the International Recognition of the Deposit of Microorganisms for the Purpose of Patent Procedure and the Regulations there under (Budapest Treaty). This assures maintenance of a viable culture of the deposit for 30 years from the date of deposit and for at least five (5) years after the most recent request for the furnishing of a sample of the deposit received by the depository. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the granting of the pertinent U.S. patent, assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 USC § 122 and the Commissioner's rules pursuant thereto (including 37 CFR § 1.14 with particular reference to 886 OG638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

The foregoing written specification is considered to be sufficient to enable one skilled in the art to practice the invention. The present invention is not to be limited in scope by the construct deposited, since the deposited embodiment is intended as a single illustration of certain aspects of the invention and any constructs that are functionally equivalent are within the scope of this invention. The deposit of material herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

SEQUENCE LISTING (624 sequences)

SEQ ID NO: 1 - DNA, 1743 bp, Homo sapiens
ccaggtccaactgcacctcggttctatcgattgaattccccggggatcctctagagatccctcgacctcgacccacgcgtccgccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccgggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgttagggtgtgtgctgtcccgggctcacggggaccctgtctccgagtcgttcgtgcagcgtgtgtaccagcccttcctcaccacctgcgacgggcaccgggcctgcagcacctaccgaaccatttataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcatcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctccttttcctcctccccttccctcgggagggtccccagaccctggcatgggatgggctgggattttttttgtgaatccacccctggctacccccaccctggttaccccaacggcatcccaaggccaggtgggccctcagctgagggaaggtacgagttcccctgctggagcctgggacccatggcacaggccaggcagcccggaggctgggtggggcctcagtgggggctgctgcctgacccccagcacaataaaaatgaaacgtgaaaaaaaaaaaaaaaaaaaaaaaaaaaaaaaaaaaaaaaaaagggcggccgcgactctagagtcgacctgcagaagcttggccgccatggcccaacttgtttattgcagcttataatggttacaaat

SEQ ID NO: 2 - protein, 295 aa, Homo sapiens
MTDSPPPGHPEEKATPPGGTGHEGLSGGAADVASGVGSGRHRARLPARPLGCVLSRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCINTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 3 - DNA, 21 bp, Artificial Sequence
  Synthetic oligonucleotide probe
tggagcagcaatatgccagcc

SEQ ID NO: 4 - DNA, 22 bp, Artificial Sequence
  Synthetic oligonucleotide probe
ttttccactcctgtcgggttgg

SEQ ID NO: 5 - DNA, 46 bp, Artificial Sequence
  Synthetic oligonucleotide probe
ggtgacacttgccagtcagatgtggatgaatgcagtgctaggaggg

SEQ ID NO: 6 - DNA, 2945 bp, Homo sapiens
cgctcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacggtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttctgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaaaaaa

SEQ ID NO: 7 - protein, 492 aa, Homo sapiens
MVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 8 - DNA, 535 bp, Homo sapiens
  unsure 33, 66, 96, 387: unknown base
cctgacagaagtgccccggagctgggggagatncaacattaagaagatgctgagcttctggtgccntttggctctaattctggccacacagagaancagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcggcccacatcaagaagttcaccttcgtctgcatggctctgtcactcacgctctgtttcgtgatgttttggacacccaacgtgtctgngaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtc

SEQ ID NO: 9 - DNA, 434 bp, Homo sapiens
  unsure 32, 54, 80, 111, 117, 122, 139, 193, 205, 221, 226, 228, 273,293, 296, 305, 336, 358, 361: unknown base
tgacggaatcccgggctgggtatcctggtttngacaagataaacccccagcaanaaattggggagcagggcaaaacagtnacgggcagcccacatcaagaagttcaccttngtttgnatggntctgtcaactcacgctntgtttcgtgatgttttggacacccaaagtgtttgagaaaattttgatagacatnatcggagtggantttgcctttgcagaantttgngntgttcctttgcggattttctcctttttcccagttccagtcacagngagggcgcatctcaccgggnggntgatgacantgaagaaaacctttgtccttgcccccagctntttggtgcggatcattgtcctnatngccagccttgtggtcctaccctacctgggggtgcacggtgcgaccctgggcgtgggttccctcctggcgggca

SEQ ID NO: 10 - DNA, 154 bp, Homo sapiens
  unsure 33, 49, 68, 83, 90, 98, 119: unknown base
tattcccagttccggtcacggggagggcgcatntcaccgggtggctgangacactgaagaaaaccttngtccttgcccccagntttgtgntgcggatnatcgtcctcatcgccagcctngtggtcctaccctacctgggggtgcacggtgagac

SEQ ID NO: 11 - DNA, 24 bp, Artificial Sequence
  Synthetic oligonucleotide probe
ctgatccggttcttggtgcccctg

SEQ ID NO: 12 - DNA, 18 bp, Artificial Sequence
  Synthetic oligonucleotide probe
gctctgtcactcacgctc

SEQ ID NO: 13 - DNA, 18 bp, Artificial Sequence
  Synthetic oligonucleotide probe
tcatctcttccctctccc

SEQ ID NO: 14 - DNA, 18 bp, Artificial Sequence
  Synthetic oligonucleotide probe
ccttccgccacggagttc

SEQ ID NO: 15 - DNA, 24 bp, Artificial Sequence
  Synthetic oligonucleotide probe
ggcaaagtccactccgatgatgtc

SEQ ID NO: 16 - DNA, 24 bp, Artificial Sequence
  Synthetic oligonucleotide probe
gcctgctgtggtcacaggtctccg

SEQ ID NO: 17 - DNA, 45 bp, Artificial Sequence
  Synthetic oligonucleotide probe
tcggggagcaggccttgaaccggggcattgctgctgtcaaggagg

SEQ ID NO: 18 - DNA, 1901 bp, Homo sapiens
gccccgcgcccggcgccgggcgcccgaagccgggagccaccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtaaaaaaaa

SEQ ID NO: 19 - protein, 457 aa, Homo sapiens
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 20 - DNA, 24 bp, Artificial Sequence
  Synthetic oligonucleotide probe
gccgcctcatcttcacgttcttcc

SEQ ID NO: 21 - DNA, 20 bp, Artificial Sequence
  Synthetic oligonucleotide probe
tcatccagctggtgctgctc

SEQ ID NO: 22 - DNA, 20 bp, Artificial Sequence
  Synthetic oligonucleotide probe
cttcttccacttctgcctgg

SEQ ID NO: 23 - DNA, 18 bp, Artificial Sequence
  Synthetic oligonucleotide probe
cctgggcaaaaatgcaac

SEQ ID NO: 24 - DNA, 24 bp, Artificial Sequence
  Synthetic oligonucleotide probe
caggaatgtagaaggcacccacgg

SEQ ID NO: 25 - DNA, 24 bp, Artificial Sequence
  Synthetic oligonucleotide probe
tggcacagatcttcacccacacgg

SEQ ID NO: 26 - DNA, 50 bp, Artificial Sequence
  Synthetic oligonucleotide probe
tgtccatcattatgctgagcccgggcgtggagagtcagctctacaagctg

SEQ ID NO: 27 - DNA, 1351 bp, Homo sapiens
gagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtacgctggtgagactgttcaggaaagaaaacagaaggatcgaaaggcactccatgagctaaaactggaagagtggaaaggcagactacaagttactgagcacctccctgagaaaattgaaagtagtttacgggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatggatatatccacccacctagattttaagcagtaaataaaacatttcgcaaaagattaaagttgaattttacagttt

SEQ ID NO: 28 - protein, 285 aa, Homo sapiens [sequence omitted]

SEQ ID NO: 29 - DNA, 324 bp, Homo sapiens
cggaagtcccttgaggagcgtcagaagcggcttccctacgtcccagagccctattacccggaatctggatgggaccgctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttcatggctggcgccgaacc

SEQ ID NO: 30 - DNA, 377 bp, Homo sapiens
  unsure 262, 330, 371: unknown base
tcaagtttgtccgtaggtcgagagaaggccatggaggtgccgccaccggcaccgcggagcttttttctgtagagcattgtgcctatttccccgagtttttgctgccgaagctgtgactgccgattcggaagtccttgaggagcgtcagaagcggcttccctacgtcccagagccctattacccggaatttggatgggaccgcctccgggagctgtttggcaaagatgaacagcagagaatttcaaaggaccttgctgatatntgtaagacggcagctacagcaggcatcattggctgggtgtatgggggaataccagcttttattcatgntaaacaacaatacattgagcagagccaggcagaaatttatnataacc

SEQ ID NO: 31 - DNA, 20 bp, Artificial Sequence
  Synthetic oligonucleotide probe
tcgtacagttacgctctccc

SEQ ID NO: 32 - DNA, 20 bp, Artificial Sequence
  Synthetic oligonucleotide probe
cttgaggagcgtcagaagcg

SEQ ID NO: 33 - DNA, 20 bp, Artificial Sequence
  Synthetic oligonucleotide probe
ataacgaatgaagcctcgtg

SEQ ID NO: 34 - DNA, 40 bp, Artificial Sequence
  Synthetic oligonucleotide probe
gctaatatctgtaagacggcagctacagcaggcatcattg

SEQ ID NO: 35 - DNA, 1819 bp, Homo sapiens
gagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaag

SEQ ID NO: 36 - protein, 204 aa, Homo sapiens
MVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 37 - DNA, 390 bp, Homo sapiens
  unsure 20, 35, 61, 83, 106, 130, 133, 187, 232, 260, 336: unknown base
tgattggagctgtaaaaaantcttcaggtgttgtnatttttttatatgattattctgtaanttgtatttattgttcagttttntgtatcttgcgcttgtttagccntgaaccaggagcaacagggtcagnttntggaggttggttggaacaatacggcaagtgctcgaaatgacatccagagaaatntaaactgctgtgggttccgaagtgttaacccaaatgacacctgtntggctagctgtgttaaaagtgaccactngtgctcgccatgtgctccaatcataggagaatatgctggagaggttttgagatttgttggtggcattggcctgttnttcagttttacagagatcctgggtgtttggctgacctacagatacaggaaccag

SEQ ID NO: 38 - DNA, 566 bp, Homo sapiens
  unsure 27: unknown base
aatcccaaattccccaatttttttggnctttttagggaaagatgtgttgtggtaaaaagtgttagtataaaaatgataatttacttgtagtcttttatgattacaccaatgtattctagaatagttatgtcttaggaaattgtggtttaatttttgacttttacaggtaagtgcaaaggagaagtggtttcatgaaatgttctaatgtataataacatttaccttcagcctcccatcagaatggaacgagttttgagtaatccaggaagtatatctatatgatcttgatattgttttatataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggaggaaatggcaatcttatgtgtgctgaaggacacagtaagagcaccaagttgtgccccacttgc

SEQ ID NO: 39 - DNA, 264 bp, Homo sapiens
  unsure 84-85, 206: unknown base
atgattattctgttacttgtatttattgttcagttttatggtatcttgcgcttgtttagcccctgaaaccaggagcaacagggnncagcttcctggaggttggttggcaacaatcacggccaagtgactccgcaaatgacatcccagagaaatcctaaactgctgtgggttccgaagtgttaacccaaatgacacctgtctggctngctgtgttaaaagtgaccactcgtgctcgccatgtgctccaatcataggagaatatgc

SEQ ID NO: 40 - DNA, 21 bp, Artificial Sequence
  Synthetic oligonucleotide probe
acccacgtctgcgttgctgcc

SEQ ID NO: 41 - DNA, 18 bp, Artificial Sequence
  Synthetic oligonucleotide probe
gagaatatgctggagagg

SEQ ID NO: 42 - DNA, 24 bp, Artificial Sequence
  Synthetic oligonucleotide probe
aggaatgcactaggattcgcgcgg

SEQ ID NO: 43 - DNA, 45 bp, Artificial Sequence
  Synthetic oligonucleotide probe
ggccccaaaggcaaggacaaagcagctgtcagggaacctccgccg

SEQ ID NO: 44 - DNA, 2061 bp, Homo sapiens
cagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccagaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctggttgtttgtagcctaa

SEQ ID NO: 45 - protein, 359 aa, Homo sapiens
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHQKPGTTKATAE

SEQ ID NO: 46 - DNA, 18 bp, Artificial Sequence
  Synthetic oligonucleotide probe
tgggctgtgtcctcatgg

SEQ ID NO: 47 - DNA, 18 bp, Artificial Sequence
  Synthetic oligonucleotide probe
tttccagcgccaattctc

SEQ ID NO: 48 - DNA, 23 bp, Artificial Sequence
  Synthetic oligonucleotide probe
agttcttggactgtgatagccac

SEQ ID NO: 49 - DNA, 24 bp, Artificial Sequence
  Synthetic oligonucleotide probe
aaacttggttgtcctcagtggctg

SEQ ID NO: 50 - DNA, 45 bp, Artificial Sequence
  Synthetic oligonucleotide probe
gtgagggacctgtctgcactgaggagagcagctgccacacggagg

SEQ ID NO: 51 - DNA, 2181 bp, Homo sapiens
cccacgcgtccgcccacgcgtccgcccacgggtccgcccacgcgtccgggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccaggtaagaaagtctctcctcttccatttttgaccccgtccctgccctcaattttgattactggcaggaaatgtggaggaaggggggtgtggcacagacccaatcctaaggccggaggccttcagggtcaggacatagctgccttccctctctcaggcaccttctgaggttgttttggccctctgaacacaaaggataatttagatccatctgccttctgcttccagaatccctgggtggtaggatcctgataattaattggcaagaattgaggcagaagggtgggaaaccaggaccacagccccaagtcccttcttatgggtggtgggctcttgggccatagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagc

SEQ ID NO: 52 - protein, 321 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAAR

SEQ ID NO: 53 - DNA, 24 bp, Artificial Sequence
  Synthetic oligonucleotide probe
tatccctccaattgagcaccctgg

SEQ ID NO: 54 - DNA, 21 bp, Artificial Sequence
  Synthetic oligonucleotide probe
gtcggaagacatcccaacaag

SEQ ID NO: 55 - DNA, 24 bp, Artificial Sequence
  Synthetic oligonucleotide probe
cttcacaatgtcgctgtgctgctc

SEQ ID NO: 56 - DNA, 24 bp, Artificial Sequence
  Synthetic oligonucleotide probe
agccaaatccagcagctggcttac

SEQ ID NO: 57 - DNA, 50 bp, Artificial Sequence
  Synthetic oligonucleotide probe
tggatgaccggagccactacacgtgtgaagtcacctggcagactcctgat

SEQ ID NO: 58 - DNA, 2458 bp, Homo sapiens
gcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcaactgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccgagattatgccattgcactccagcctgggtgacagagcgggactccgtctc

SEQ ID NO: 59 - protein, 373 aa, Homo sapiens
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 60 - DNA, 24 bp, Artificial Sequence
  Synthetic oligonucleotide probe
ccagtgcacagcaggcaacgaagc

SEQ ID NO: 61 - DNA, 24 bp, Artificial Sequence
  Synthetic oligonucleotide probe
actaggctgtatgcctgggtgggc

SEQ ID NO: 62 - DNA, 43 bp, Artificial Sequence
  Synthetic oligonucleotide probe
gtatgtacaaagcatcggcatggttgcaggagcagtgacaggc

SEQ ID NO: 63 - DNA, 3534 bp, Homo sapiens
gtcgttcctttgctctctcgcgcccagtcctcctccctggttctcctcagccgctgtcggaggagagcacccggagacgcgggctgcagtcgcggcggcttctccccgcctgggcggcctcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttaaaaaaaaaa

SEQ ID NO: 64 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 65 - DNA, 24 bp, Artificial Sequence
  Synthetic oligonucleotide probe
gtagcagtgcacatggggtgttgg

SEQ ID NO: 66 - DNA, 24 bp, Artificial Sequence
  Synthetic oligonucleotide probe
accgcacatcctcagtctctgtcc

SEQ ID NO: 67 - DNA, 50 bp, Artificial Sequence
  Synthetic oligonucleotide probe
acgatgatcgcgggctcccttctcctgcttggattccttagcaccaccac

SEQ ID NO: 68 - DNA, 2412 bp, Homo sapiens
atgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccagggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcattgtctggcgtgtctgcgtggactggtgacgtgaatcaaaatcatccactgaaa

SEQ ID NO: 69 - protein, 453 aa, Homo sapiens
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 70 - DNA, 24 bp, Artificial Sequence
  Synthetic oligonucleotide probe
tgacatcgcccttatgaagctggc

SEQ ID NO: 71 - DNA, 24 bp, Artificial Sequence
  Synthetic oligonucleotide probe
tacacgtccctgtggttgcagatc

SEQ ID NO: 72 - DNA, 50 bp, Artificial Sequence
  Synthetic oligonucleotide probe
cgttcaatgcagaaatgatccagcctgtgtgcctgcccaactctgaagag

SEQ ID NO: 73 - DNA, 3305 bp, Homo sapiens
cccacgcgtccgtcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaatgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccctctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcaatgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaat

SEQ ID NO: 74 - protein, 735 aa, Homo sapiens [sequence omitted]

SEQ ID NO: 75 - DNA, 483 bp, Homo sapiens
  unsure 30, 94, 143, 156, 163, 179, 193, 369, 371, 381, 390, 473: unknown base
tcccaaggcttcttggatggcagatgattntggggttttgcattgtttccctgacaacgaaaacaaaacagttttgggggttcaggaggggaantccagcctacccaggaagtttgcagaaacagtgcaaggaagggcagganttcctggttgagntttttgntaaaacatggacatgnttcagtgctgctcntgagagagtagcaggttaccacttttggcaggccccagccctgcagcaaggaggaagaggactcaaaagtttggcctttcactgagcctccacagcagtgggggagaagcaagggttgggcccagtgtcccctttccccagtgacacctcagccttggcagccctgataactggtntntggctgcaanttaatgctntgatatggcttttagcatttattatatgaaaatagcagggttttagtttttaatttatcagagaccctgccacccattccatntccatccaag

SEQ ID NO: 76 - DNA, 27 bp, Artificial Sequence
  Synthetic oligonucleotide probe
gtctcagcacgtgttctggtctcaggg

SEQ ID NO: 77 - DNA, 18 bp, Artificial Sequence
  Synthetic oligonucleotide probe
catgagcatgtgcacggc

SEQ ID NO: 78 - DNA, 18 bp, Artificial Sequence
  Synthetic oligonucleotide probe
tacctgcacgatgggcac

SEQ ID NO: 79 - DNA, 18 bp, Artificial Sequence
  Synthetic oligonucleotide probe
cactgggcacctcccttc

SEQ ID NO: 80 - DNA, 26 bp, Artificial Sequence
  Synthetic oligonucleotide probe
ctccaggctggtctccaagtccttcc

SEQ ID NO: 81 - DNA, 24 bp, Artificial Sequence
  Synthetic oligonucleotide probe
tccctgttggactctgcagcttcc

SEQ ID NO: 82 - DNA, 19 bp, Artificial Sequence
  Synthetic oligonucleotide probe
cttcgctgggaagagtttg

SEQ ID NO: 83 - DNA, 50 bp, Artificial Sequence
  Synthetic oligonucleotide probe
gtgcaaccaacagatacaaactcttcccagcgaagaagctgaaaagcgtc

SEQ ID NO: 84 - DNA, 1714 bp, Homo sapiens
catcctgcaacatggtgaaaccacgcctggctaattttgttgtatttttggtagagatgggatttcaccgtgttagccaggattgtctcaatctgacctcatgatctgcccgcctcggcctcccaaagtgctgggattacaggcgagtgcaaccacacccggccacaaactttttaagaagttaatgaaaccataccttttacatttttaatgacaggaaaatgctcacaataattgttaacccaaaattctggatacaaaagtacaatctttactgtgtaaatacatgtatatgtactatatgaaaatataccaaatatcaataatacttatctctgggtaaaaacctcttctcataccctgtgctaacaacttttaacaaaaaatttgcatcacttttaagaatcaagaaaaatttctgaaggtcatatgggacagaaaaaaaaaccaagggaaaaatcacgccacttgggaaaaaaagattcgaaatctgcctttttatagatttgtaattaataaggtccaggctttctaagcaacttaaatgttttgtttcgaaacaaagtacttgtctggatgtaggaggaaagggagtgatgtcactgccattatgatgccccttgaatataagaccctacttgctatctcccctgcaccagccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaacagtgccctacagcctacagccggtctccttgtggtcttgcttgcccttctacatctctaccattaagaggcaggtcaagaaacagctacagttctccaacccatacactaaaaccgaatccaaatggtgcctagaagttcaatgtggcaaggaaaaaaaccaggtcttcatcaaatctactaatttcactccttattaacagagaaacgcttgagagtctcaaactggactggtttaaagagcatctgaaggatttgactagatgataaatgcctgtactcccagtactttgggaggcctaggccggcggatcacctgaggtcaggagtttgagactaacctggccaaaatggtgaaaccccatctgtactaaaaatacaaatattgactgggcgtggtggtgagtgcctgtgatcccagctactcaggtggctgaagcaggacaatcacttgaactcaggaggcagaggttgcagtgagctgagatcgcgctactgcactctagcctagcctgggcaacagagtgagacttcgtctcaaaaaaaaaaaagccaagtgcagtggctcacgcctgtaatcccggcactttgggaggccgaggtgggcggatcacgaggtcaggagatcaagaccatcctggctaatacagtgaaaccctgtctctactaaaaatacaaaaaattagccggggatggtggcaggcacctggagtcccagctactcgggaggctgaggcaggagaatagcgtgaactcaggaggcggagcttgcagtgagccgagattgcgctactgcactccagcctgggcgacagcgcgagactccgtctcaaaaaaaaaaaaaaaaaaaaaaaa

SEQ ID NO: 85 - protein, 67 aa, Homo sapiens
MGKGMVAMLILGLLLLALLLPVQVSSFVPLTSMPEATAAETTKPSNSALQPTAGLLVVLLALLHLYH

SEQ ID NO: 86 - DNA, 23 bp, Artificial Sequence
  Synthetic oligonucleotide probe
acgggcacactggatcccaaatg

SEQ ID NO: 87 - DNA, 29 bp, Artificial Sequence
  Synthetic oligonucleotide probe
ggtagagatgtagaagggcaagcaagacc

SEQ ID NO: 88 - DNA, 50 bp, Artificial Sequence
  Synthetic oligonucleotide probe
gctccctacccgtgcaggtttcttcatttgttcctttaaccagtatgccg

SEQ ID NO: 89 - DNA, 2956 bp, Homo sapiens
gccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaa

SEQ ID NO: 90 - protein, 432 aa, Homo sapiens
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 91 - DNA, 20 bp, Artificial Sequence
  Synthetic oligonucleotide probe
atgttcttcgcgccctggtg

SEQ ID NO: 92 - DNA, 21 bp, Artificial Sequence
  Synthetic oligonucleotide probe
ccaagccaacacactctacag

SEQ ID NO: 93 - DNA, 24 bp, Artificial Sequence
  Synthetic oligonucleotide probe
aagtggtcgccttgtgcaacgtgc

SEQ ID NO: 94 - DNA, 23 bp, Artificial Sequence
  Synthetic oligonucleotide probe
ggtcaaaggggatatatcgccac

SEQ ID NO: 95 - DNA, 49 bp, Artificial Sequence
  Synthetic oligonucleotide probe
gcatggaagatgccaaagtctatgtggctaaagtggactgcacggccca

SEQ ID NO: 96 - DNA, 1016 bp, Homo sapiens
cttttctgaggaaccacagcaatgaatggctttgcatccttgcttcgaagaaaccaatttatcctcctggtactatttcttttgcaaattcagagtctgggtctggatattgatagccgtcctaccgctgaagtctgtgccacacacacaatttcaccaggacccaaaggagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgtccacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaacttccctcatcctacgtatttgctattttcctgtgaccgtcattacagttattgttatccatcctttttttcctgattgtactacatttgatctgagtcaacatagctagaaaatgctaaactgaggtatggagcctccatcatcaaaaaaaaaaaaaaaa

SEQ ID NO: 97 - protein, 277 aa, Homo sapiens [sequence omitted]

SEQ ID NO: 98 - DNA, 24 bp, Artificial Sequence
  Synthetic oligonucleotide probe
cgctgactatgttgccaagagtgg

SEQ ID NO: 99 - DNA, 24 bp, Artificial Sequence
  Synthetic oligonucleotide probe
gatgatggaggctccatacctcag

SEQ ID NO: 100 - DNA, 50 bp, Artificial Sequence
  Synthetic oligonucleotide probe
gtgttcattggcgtgaatgaccttgaaagggagggacagtacatgttcac

SEQ ID NO: 101 - DNA, 2574 bp, Homo sapiens
ggttctatcgattcgaattcggccacactggccggatcctctagagatccctcgacctcgacccacgcgtccgctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctaaaaaaaaaaaaaaaaaaaaaaaaaaaaaagggcggccgcgactctagagtcgacctgcagtagggataacagggtaataagcttggccgccatggcccaacttgtttattgcag

SEQ ID NO: 102 - protein, 730 aa, Homo sapiens
MGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 103 - DNA, 22 bp, Artificial Sequence
  Synthetic oligonucleotide probe
gagagccatggggctccacctg

SEQ ID NO: 104 - DNA, 18 bp, Artificial Sequence
  Synthetic oligonucleotide probe
ggagaatgtggccacaac

SEQ ID NO: 105 - DNA, 26 bp, Artificial Sequence
  Synthetic oligonucleotide probe
gccctggcacagtgactccatagacg

SEQ ID NO: 106 - DNA, 18 bp, Artificial Sequence
  Synthetic oligonucleotide probe
atccacttcagcggacac

SEQ ID NO: 107 - DNA, 45 bp, Artificial Sequence
  Synthetic oligonucleotide probe
ccagtgccaggatacctctcttccccccagagcataacagacacg

SEQ ID NO: 108 - DNA, 2579 bp, Homo sapiens
cctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggttttttttttctcatttaaaat

SEQ ID NO: 109 - protein, 555 aa, Homo sapiens
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 110 - DNA, 21 bp, Artificial Sequence
  Synthetic oligonucleotide probe
aagcgtgacagcgggcacgtc

SEQ ID NO: 111 - DNA, 24 bp, Artificial Sequence
  Synthetic oligonucleotide probe
tgcacagtctctgcagtgcccagg

SEQ ID NO: 112 - DNA, 40 bp, Artificial Sequence
  Synthetic oligonucleotide probe
gaatgctggaacgggcacagcaaagccagatacttgcctg

SEQ ID NO: 113 - DNA, 4649 bp, Homo sapiens
cggacgcgtgggcggacgcgtgggcaaaagaactcggagtgccaaagctaaataagttagctgagaaaacgcacgcagtttgcagcgcctgcgccgggtgcgccaactacgcaaagaccaagcgggctccgcgcggaccggccgcggggctagggacccggctttggccttcaggctccctagcagcggggaaaaggaattgctgcccggagtttctgcggaggtggagggagatcaggaaacggcttcttcctcacttcgccgcctggtgagtgtcggggagattggcaaacgcctaggaaaggactggggaaaatagccctgggaaagtggagaaggtgatcaggaggccggtccactacggcagtttatctgtctgatcagagccagacgcgacgcgtccacttcgcagttctttccaggtgtggggaccgcaggacagacggccgatcccgccgccctccgtaccagcactcccaggagagtcagcctcgctccccaacgtcgagggcgctctggccacgaaaagttcctgtccactgtgattctcaattccttgcttggtttttttctccagagaacttttgggtggagatattaacttttttctttttttttttccttggtggaagctgctctagggaggggggaggaggaggagaaagtgaaatgtgctggagaagagcgagccctccttgttcttccggagtcccatccattaagccatcacttctggaagattaaagttgtcggacatggtgacagctgagaggagaggaggatttcttgccaggtggagagtcttcaccgtctgttgggtgcatgtgtgcgcccgcagcggcgcggggcgcgtggttctccgcgtggagtctcacctgggacctgagtgaatggctcccaggggctgtgcggggcatccgcctccgccttctccacaggcctgtgtctgtcctggaaagatgctagcaatgggggcgctggcaggattctggatcctctgcctcctcacttatggttacctgtcctggggccaggccttagaagaggaggaagaaggggccttactagctcaagctggagagaaactagagcccagcacaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaagtatcagatacacaccggacttcaacattctatcataagacctacccaacccaactgtttacctctggacaatgccaccctacctcagaaactgaaggaggttggatattcaacgcatatggtcggaaaatggcacttgggttttaacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatactgcctatcaagctgttcattcaccactgcaagctcctggcaggtatttcgaacactaccgatccattatcaacataaacaggagaagatatgctgccatgctttcctgcttagatgaagcaatcaacaacgtgacattggctctaaagacttatggtttctataacaacagcattatcatttactcttcagataatggtggccagcctacggcaggagggagtaactggcctctcagaggtagcaaaggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgacccctatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctctcgctcctttagaaaacgtggtgagtcctgagttccactgctgtgcttcagtcaactgaccaaacactgctttgaattataggaggagaacaataacctaccatccgcaagcatgctaatttgatggaagttacagggtagcatgattaaaactacctttgataaattacagtcaaagattgtgtcacctcaaaggccttgaagaatatattttcttggtgaatttttgtatgtctgtcatatgacacttgggttttttaattaattctattttatatatataaatatatgtttcttttcctgtgaaaagctgtttttctcacatgtgaacagcttgcacctcattttaccatgcgtgagggaatggcaaataagaatgtttgagcacactgcccacaatgaatgtaactattttctaaacactttactagaagaacatttcagtataaaaaacctaatttatttttacagaaaaatattttgttgtttttataaaaagttatgcaaatgacttttatttttatttcctgcataccattagaagaattttatttcatttcttcaaattatcaagcactgtaatactataaattaatgtaatactgtgtgaattcagactataaaaaacatcattcagaaaactttataatcgtcattgttcaatcaagattttgaatgtaataagatgaatatattccttacaaattacttggaaattcaatgtttgtgcagagttgagacaactttattgtttctatcataaactatttatgtatcttaattattaaaatgatttactttatggcactagaaaatttactgtggcttttctgatctaacttctagctaaaattgtatcattggtcctaaaaaataaaaatctttactaataggcaattgaaggaatggtttgctaacaaccacagtaatataatatgattttacagatagatgcttccccttggctatgacatggagaaagattttcccataataataactaatatttatattaggttggtgcaaaactagttgcggtttttcccattaaaagtaataaccttactcttatacaaagtggacactgtggggagatacagagaaatggaagatacggatcctgcctggagtaggtaaccttgcttggaaaccccacatgcaaacgtcatgaggagaattaaaggagtattatcagtaatgaagtttatcatgggtcatcaatgagcatagattggtgtggatcctgtagaccctggtgttttctttgaagtgccctctcctaatgcagaggccttgaagcttacagtatacacttgaaaagtcacagatagctagaattatgatctttgaagttataactgtgatctgaaaatgtgtgtggtggtatgacagcataccattaaatacatttacatcacagctcaaaggactgtgatataatccatttatatcacaactcaaaggactgtgatataatccatttatatcacagctcacagtttctgaaaatgtataaaagaatctataatctagtactgaaattactaaattgggtaagatgatttaaatgattttaattttaacattttatttctagaatatatggctccattttattttatagtgtaaagttgtatttcctaaagtttgtgttttgtcgacagtatcttttaaatgagtcttaaaaataaaggcatattgttcatgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 114 - protein, 515 aa, Homo sapiens
MAPRGCAGHPPPPSPQACVCPGKMLAMGALAGFWILCLLTYGYLSWGQALEEEEEGALLAQAGEKLEPSTTSTSQPHLIFILADDQGFRDVGYHGSEIKTPTLDKLAAEGVKLENYYVQPICTPSRSQFITGKYQIHTGLQHSIIRPTQPNCLPLDNATLPQKLKEVGYSTHMVGKWHLGFNRKECMPTRRGFDTFFGSLLGSGDYYTHYKCDSPGMCGYDLYENDNAAWDYDNGIYSTQMYTQRVQQILASHNPTKPIFLYTAYQAVHSPLQAPGRYFEHYRSIININRRRYAAMLSCLDEAINNVTLALKTYGFYNNSIIIYSSDNGGQPTAGGSNWPLRGSKGTYWEGGIRAVGFVHSPLLKNKGTVCKELVHITDWYPTLISLAEGQIDEDIQLDGYDIWETISEGLRSPRVDILHNIDPYTPRQKMAPGQQAMGSGTLQSSQPSECSTGNCLQEILATATGSPLSLSATWDRTGGTMNGSPCQLAKVYGFSTSQPTHMRGWTYLTGIQES

SEQ ID NO: 115 - DNA, 24 bp, Artificial Sequence
  Synthetic oligonucleotide probe
cccaacccaactgtttacctctgg

SEQ ID NO: 116 - DNA, 24 bp, Artificial Sequence
  Synthetic oligonucleotide probe
ctctctgagtgtacatctgtgtgg

SEQ ID NO: 117 - DNA, 53 bp, Artificial Sequence
  Synthetic oligonucleotide probe
  unsure 33: unknown base
gccaccctacctcagaaactgaaggaggttggntattcaacgcatatggtcgg

SEQ ID NO: 118 - DNA, 2260 bp, Homo sapiens
  unsure 2009, 2026, 2033, 2055, 2074, 2078, 2086: unknown base
cggacgcgtgggtgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccncattatattataaaatntggaaangtcagtttatctcccctcctcngtatatctgatttgtatangtangttgatgngcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaattctttgtaataataa

SEQ ID NO: 119 - protein, 338 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEK

SEQ ID NO: 120 - DNA, 22 bp, Artificial Sequence
  Synthetic oligonucleotide probe
cctcagtggccacatgctcatg

SEQ ID NO: 121 - DNA, 24 bp, Artificial Sequence
  Synthetic oligonucleotide probe
ggctgcacgtatggctatccatag

SEQ ID NO: 122 - DNA, 50 bp, Artificial Sequence
  Synthetic oligonucleotide probe
gataaactgtcagtacagctgtgaagacacagaagaagggccacagtgcc

SEQ ID NO: 123 - DNA, 1199 bp, Homo sapiens
gggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaa

SEQ ID NO: 124 - protein, 289 aa, Homo sapiens
MVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 125 - DNA, 19 bp, Artificial Sequence
  Synthetic oligonucleotide probe
gcaatgaactgggagctgc

SEQ ID NO: 126 - DNA, 19 bp, Artificial Sequence
  Synthetic oligonucleotide probe
ctgtgaatagcatcctggg

SEQ ID NO: 127 - DNA, 20 bp, Artificial Sequence
  Synthetic oligonucleotide probe
cttttcaagccactggaggg

SEQ ID NO: 128 - DNA, 24 bp, Artificial Sequence
  Synthetic oligonucleotide probe
ctgtagacatccaagctggtatcc

SEQ ID NO: 129 - DNA, 23 bp, Artificial Sequence
  Synthetic oligonucleotide probe
aagagtctgcatccacaccactc

SEQ ID NO: 130 - DNA, 46 bp, Artificial Sequence
  Synthetic oligonucleotide probe
acctgacgctactatgggccgagtggcagggacgacgcccagaatg

SEQ ID NO: 131 - DNA, 2365 bp, Homo sapiens
gcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggtcttcaagccgctcagcgtgcctgtggacagcgtggccccggcccccccaagcctcaggagggcaacacagtccctggcgagtggccctggcaggccagtgtgaggaggcaaggagcccacatctgcagcggctccctggtggcagacacctgggtcctcactgctgcccactgctttgaaaaggcagcagcaacagaactgaattcctggtcagtggtcctgggttctctgcagcgtgagggactcagccctggggccgaagaggtgggggtggctgccctgcagttgcccagggcctataaccactacagccagggctcagacctggccctgctgcagctcgcccaccccacgacccacacacccctctgcctgccccagcccgcccatcgcttcccctttggagcctcctgctgggccactggctgggatcaggacaccagtgatgctcctgggaccctacgcaatctgcgcctgcgtctcatcagtcgccccacatgtaactgtatctacaaccagctgcaccagcgacacctgtccaacccggcccggcctgggatgctatgtgggggcccccagcctggggtgcagggcccctgtcagggagattccgggggccctgtgctgtgcctcgagcctgacggacactgggttcaggctggcatcatcagctttgcatcaagctgtgcccaggaggacgctcctgtgctgctgaccaacacagctgctcacagttcctggctgcaggctcgagttcagggggcagctttcctggcccagagcccagagaccccggagatgagtgatgaggacagctgtgtagcctgtggatccttgaggacagcaggtccccaggcaggagcaccctccccatggccctgggaggccaggctgatgcaccagggacagctggcctgtggcggagccctggtgtcagaggaggcggtgctaactgctgcccactgcttcattgggcgccaggccccagaggaatggagcgtagggctggggaccagaccggaggagtggggcctgaagcagctcatcctgcatggagcctacacccaccctgaggggggctacgacatggccctcctgctgctggcccagcctgtgacactgggagccagcctgcggcccctctgcctgccctatcctgaccaccacctgcctgatggggagcgtggctgggttctgggacgggcccgcccaggagcaggcatcagctccctccagacagtgcccgtgaccctcctggggcctagggcctgcagccggctgcatgcagctcctgggggtgatggcagccctattctgccggggatggtgtgtaccagtgctgtgggtgagctgcccagctgtgagggcctgtctggggcaccactggtgcatgaggtgaggggcacatggttcctggccgggctgcacagcttcggagatgcttgccaaggccccgccaggccggcggtcttcaccgcgctccctgcctatgaggactgggtcagcagtttggactggcaggtctacttcgccgaggaaccagagcccgaggctgagcctggaagctgcctggccaacataagccaaccaaccagctgctgacaggggacctggccattctcaggacaagagaatgcaggcaggcaaatggcattactgcccctgtcctccccaccctgtcatgtgtgattccaggcaccagggcaggcccagaagcccagcagctgtgggaaggaacctgcctggggccacaggtgcccactccccaccctgcaggacaggggtgtctgtggacactcccacacccaactctgctaccaagcaggcgtctcagctttcctcctcctttactctttcagatacaatcacgccagccacgttgttttgaaaatttctttttttggggggcagcagttttcctttttttaaacttaaataaattgttacaaaataaaa

SEQ ID NO: 132 - protein, 571 aa, Homo sapiens
MLLSSLVSLAGSVYLAWILFFVLYDFCIVCITTYAINVSLMWLSFRKVQEPQGKAKRHGNTVPGEWPWQASVRRQGAHICSGSLVADTWVLTAAHCFEKAAATELNSWSVVLGSLQREGLSPGAEEVGVAALQLPRAYNHYSQGSDLALLQLAHPTTHTPLCLPQPAHRFPFGASCWATGWDQDTSDAPGTLRNLRLRLISRPTCNCIYNQLHQRHLSNPARPGMLCGGPQPGVQGPCQGDSGGPVLCLEPDGHWVQAGIISFASSCAQEDAPVLLTNTAAHSSWLQARVQGAAFLAQSPETPEMSDEDSCVACGSLRTAGPQAGAPSPWPWEARLMHQGQLACGGALVSEEAVLTAAHCFIGRQAPEEWSVGLGTRPEEWGLKQLILHGAYTHPEGGYDMALLLLAQPVTLGASLRPLCLPYPDHHLPDGERGWVLGRARPGAGISSLQTVPVTLLGPRACSRLHAAPGGDGSPILPGMVCTSAVGELPSCEGLSGAPLVHEVRGTWFLAGLHSFGDACQGPARPAVFTALPAYEDWVSSLDWQVYFAEEPEPEAEPGSCLANISQPTSC

SEQ ID NO: 133 - DNA, 24 bp, Artificial Sequence
  Synthetic oligonucleotide probe
cctgtgctgtgcctcgagcctgac

SEQ ID NO: 134 - DNA, 24 bp, Artificial Sequence
  Synthetic oligonucleotide probe
gtgggcagcagttagcaccgcctc

SEQ ID NO: 135 - DNA, 45 bp, Artificial Sequence
  Synthetic oligonucleotide probe
ggctggcatcatcagctttgcatcaagctgtgcccaggaggacgc

SEQ ID NO: 136 - DNA, 1998 bp, Homo sapiens
cgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacrgctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctccctgccccaagtgaagacagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaaaaaaaaaaaaaaaaaaa

SEQ ID NO: 137 - protein, 316 aa, Homo sapiens
  unsure 233: unknown amino acid
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSVLRVVLGANGTYSCLVRNPVLQQDAHXSVTITGQPMTFPPEALWVTVGLSVCLIALLVALAFVCWRKIKQSCEEENAGAEDQDGEGEGSKTALQPLKHSDSKEDDGQEIA

SEQ ID NO: 138 - DNA, 24 bp, Artificial Sequence
  Synthetic oligonucleotide probe
ctggcacagctcaacctcatctgg

SEQ ID NO: 139 - DNA, 20 bp, Artificial Sequence
  Synthetic oligonucleotide probe
gctgtctgtctgtctcattg

SEQ ID NO: 140 - DNA, 20 bp, Artificial Sequence
  Synthetic oligonucleotide probe
ggacacagtatactgaccac

SEQ ID NO: 141 - DNA, 24 bp, Artificial Sequence
  Synthetic oligonucleotide probe
tgcgaaccaggcagctgtaagtgc

SEQ ID NO: 142 - DNA, 24 bp, Artificial Sequence
  Synthetic oligonucleotide probe
tggaagaagagggtggtgatgtgg

SEQ ID NO: 143 - DNA, 45 bp, Artificial Sequence
  Synthetic oligonucleotide probe
cagctgacagacaccaaacagctggtgcacagtttcaccgaaggc

SEQ ID NO: 144 - DNA, 2336 bp, Homo sapiens
  unsure 1620, 1673: unknown base
ttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaagtagcccggcgtggtgatgcgtgcctgtaatcccagctacccaggaaggctgaggcggcagaatcacttgaacccgaggccgaggttgcggtaagccgagatcacctncagcctggacactctgtctcgaaaaaagaaaagaacacggttaataccatatnaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctcaaaaaaaaaaaaaagaagcagacctacagcagctactattgaataaatacctatcctggatttt

SEQ ID NO: 145 - protein, 211 aa, Homo sapiens
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 146 - DNA, 26 bp, Artificial Sequence
  Synthetic oligonucleotide probe
ctttccttgcttcagcaacatgaggc

SEQ ID NO: 147 - DNA, 25 bp, Artificial Sequence
  Synthetic oligonucleotide probe
gcccagagcaggaggaatgatgagc

SEQ ID NO: 148 - DNA, 49 bp, Artificial Sequence
  Synthetic oligonucleotide probe
gtggaacgcggtcttgactctgttcgtcacttctttgattggggctttg

SEQ ID NO: 149 - DNA, 2196 bp, Homo sapiens
aataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttggtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggaggggccgctgtcacctgcccagtgcttgcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcctgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcggccacgctactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaa

SEQ ID NO: 150 - protein, 215 aa, Homo sapiens
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 151 - DNA, 524 bp, Homo sapiens
  unsure 103, 233: unknown base
gttgtatatgtcctgaagtacatccgtgcattttttttagcatccaaccatcctcccttgtagttctcgccccctcaaatcaccttctcccttagcccacccnactaacatctcagtctctgaaaatgcacagagatgcctggctacctcgccctgccttcagcctcacggggctcagtctctttttctctttggtgccaccaggacggagcatggaggtccacagtacctgnccaccctcaacgtcctcaatggctctgacgcccgcctgccctgcccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccc

SEQ ID NO: 152 - DNA, 368 bp, Homo sapiens
  unsure 56, 123: unknown base
tcacggggctcatctctttttctctttggtgcccaccaggacggagcatggaggtncacatacctgccaccctcaacgtcctcaatggctttgacgcccgcctgccctgcaccttcaactccngctacacagtgaaccacaaacagttctccctgaactggatttaccaggagtgcaacaactggctctgaggagatgttcctccagttcccgcatggaagatcatttaacctgaaagctggaagcggttttcaagaaccgcgtggaagtttctcagggaaccccagcaagtacgatgtgtcggtgatgctgagaaacgtgcagccggaggatgaggggatttacaactgctacatcatgaacccccc

SEQ ID NO: 153 - DNA, 24 bp, Artificial Sequence
  Synthetic oligonucleotide probe
acggagcatggaggtccacagtac

SEQ ID NO: 154 - DNA, 23 bp, Artificial Sequence
  Synthetic oligonucleotide probe
gcacgtttctcagcatcaccgac

SEQ ID NO: 155 - DNA, 50 bp, Artificial Sequence
  Synthetic oligonucleotide probe
cgcctgccctgcaccttcaactcctgctacacagtgaaccacaaacagtt

SEQ ID NO: 156 - DNA, 2680 bp, Homo sapiens
tgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaaatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcaggctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaaaaaaaaaaaaaaaaaaa

SEQ ID NO: 157 - protein, 412 aa, Homo Sapien
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 158 - DNA, 23 bp, Artificial Sequence
  Synthetic oligonucleotide probe
ctggggctacacacggggtgagg

SEQ ID NO: 159 - DNA, 24 bp, Artificial Sequence
  Synthetic oligonucleotide probe
ggtgccgctgcagaaagtagagcg

SEQ ID NO: 160 - DNA, 45 bp, Artificial Sequence
  Synthetic oligonucleotide probe
gccccaaatgaaaacgggccctacttcctggccctccgcgagatg

SEQ ID NO: 161 - DNA, 1512 bp, Homo sapiens
cggacgcgtgggcggacgcgtggggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagtggcggttagcgtgggaagggggacagagagggccctcccctctgccctggactttcccatcagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcaaag

SEQ ID NO: 162 - protein, 224 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 163 - DNA, 24 bp, Artificial Sequence
  Synthetic oligonucleotide probe
tggtcttcgccttgatcgtgttct

SEQ ID NO: 164 - DNA, 20 bp, Artificial Sequence
  Synthetic oligonucleotide probe
gtgtactgagcggcggttag

SEQ ID NO: 165 - DNA, 23 bp, Artificial Sequence
  Synthetic oligonucleotide probe
ctgaaggtgatggctgccctcac

SEQ ID NO: 166 - DNA, 23 bp, Artificial Sequence
  Synthetic oligonucleotide probe
ccaggaggctcatgggaaagtcc

SEQ ID NO: 167 - DNA, 50 bp, Artificial Sequence
  Synthetic oligonucleotide probe
ccacgagtctaagcagatgtactgcgtgttcaaccgcaacgaggatgcct

SEQ ID NO: 168 - DNA, 3143 bp, Homo sapiens
gagccacctaccctgctccgaggccaggcctgcagggcctcatcggccagagggtgatcagtgagcagaaggatgcccgtggccgaggccccccaggtggctggcgggcagggggacggaggtgatggcgaggaagcggagccagaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgatgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggcctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatcaaaaaaaaaaaaaaaaaaaaa

SEQ ID NO: 169 - protein, 802 aa, Homo sapiens [sequence omitted]

SEQ ID NO: 170 - DNA, 1327 bp, Homo sapiens
gcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgatgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggcctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtat

SEQ ID NO: 171 - DNA, 24 bp, Artificial Sequence
  Synthetic oligonucleotide probe
taacagctgcccactgcttccagg

SEQ ID NO: 172 - DNA, 22 bp, Artificial Sequence
  Synthetic oligonucleotide probe
taatccagcagtgcaggccggg

SEQ ID NO: 173 - DNA, 50 bp, Artificial Sequence
  Synthetic oligonucleotide probe
atggcctccacggtgctgtggaccgtgttcctgggcaaggtgtggcagaa

SEQ ID NO: 174 - DNA, 25 bp, Artificial Sequence
  Synthetic oligonucleotide probe
tgcctatgcactgaggaggcagaag

SEQ ID NO: 175 - DNA, 25 bp, Artificial Sequence
  Synthetic oligonucleotide probe
aggcagggacacagagtccattcac

SEQ ID NO: 176 - DNA, 50 bp, Artificial Sequence
  Synthetic oligonucleotide probe
agtatgatttgccgtgcacccagggccagtggacgatccagaacaggagg

SEQ ID NO: 177 - DNA, 1510 bp, Homo sapiens
ggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagaggtaaccttcagtccctggagtgtccctgaggaaggcccttaatacctccttcttaataccatgctgcagagcagggcacatcctagcccaggagaagtggccagcacaatccaatcaaatcgttgcaaatcagattacactgtgcatgtcctaggaaagggaatctttacaaaataaacagtgtggacccctaataaaaaaaaaaaaaaaaaaaaaaaaaaaaaaaaaaaaaaaaaaaaaaaaaaaaaaaaa

SEQ ID NO: 178 - protein, 354 aa, Homo sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 179 - DNA, 23 bp, Artificial Sequence
  Synthetic oligonucleotide probe
gtgagcatgagcgagccgtccac

SEQ ID NO: 180 - DNA, 26 bp, Artificial Sequence
  Synthetic oligonucleotide probe
gctattacaacggttcttgcggcagc

SEQ ID NO: 181 - DNA, 44 bp, Artificial Sequence
  Synthetic oligonucleotide probe
ttgactctctggtgaatcaggacaagccgagttttgccttccag

SEQ ID NO: 182 - DNA, 3240 bp, Homo sapiens
cggacgcgtgggcggacgcgtgggcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctc

SEQ ID NO: 183 - protein, 713 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 184 - DNA, 20 bp, Artificial Sequence
  Synthetic oligonucleotide probe
ggctgtcactgtggagacac

SEQ ID NO: 185 - DNA, 18 bp, Artificial Sequence
  Synthetic oligonucleotide probe
gcaaggtcattacagctg

SEQ ID NO: 186 - DNA, 23 bp, Artificial Sequence
  Synthetic oligonucleotide probe
agaacataggagcagtcccactc

SEQ ID NO: 187 - DNA, 23 bp, Artificial Sequence
  Synthetic oligonucleotide probe
tgcctgctgctgcacaatctcag

SEQ ID NO: 188 - DNA, 45 bp, Artificial Sequence
  Synthetic oligonucleotide probe
ggctattgcttgccttgggacagaccctgtggcttaggctctggc

SEQ ID NO: 189 - DNA, 663 bp, Homo sapiens
cgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccaaaaaaaaaaaaaaaaaa

SEQ ID NO: 190 - protein, 152 aa, Homo sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 191 - DNA, 495 bp, Homo sapiens
  unsure 78, 212, 234, 487: unknown base
gggcgagaagtaggggagggcgtgttccgccgcggtggcggttgctatcgttttgcagaacctactcaggcagccagntgagaagagttgagggaaagtgctgctgctgggtctgcagacgcgatggataacgtgcagccgaaaataaaacatcgccccttctgcttcagtgtgaaaggccacgtgaagatgctgcggctggcactaactgngacatctatgaccttttttatnatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtnttgccgac

SEQ ID NO: 192 - DNA, 25 bp, Artificial Sequence
  Synthetic oligonucleotide probe
cgttttgcagaacctactcaggcag

SEQ ID NO: 193 - DNA, 25 bp, Artificial Sequence
  Synthetic oligonucleotide probe
cctccaccaactgtcaatgttgtgg

SEQ ID NO: 194 - DNA, 40 bp, Artificial Sequence
  Synthetic oligonucleotide probe
aaagtgctgctgctgggtctgcagacgcgatggataacgt

SEQ ID NO: 195 - DNA, 1879 bp, Homo sapien
cagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaa

SEQ ID NO: 196 - protein, 518 aa, Homo sapien
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 197 - DNA, 21 bp, Artificial Sequence
  Synthetic oligonucleotide probe
cgcagaagctacagattctcg

SEQ ID NO: 198 - DNA, 19 bp, Artificial Sequence
  Synthetic oligonucleotide probe
ggaaattggaggccaaagc

SEQ ID NO: 199 - DNA, 20 bp, Artificial Sequence
  Synthetic oligonucleotide probe
ggatgtagccagcaactgtg

SEQ ID NO: 200 - DNA, 19 bp, Artificial Sequence
  Synthetic oligonucleotide probe
gccttggctcgttctcttc

SEQ ID NO: 201 - DNA, 18 bp, Artificial Sequence
  Synthetic oligonucleotide probe
ggtcctgtgcctggatgg

SEQ ID NO: 202 - DNA, 22 bp, Artificial Sequence
  Synthetic oligonucleotide probe
gacaagactacctccgttggtc

SEQ ID NO: 203 - DNA, 24 bp, Artificial Sequence
  Synthetic oligonucleotide probe
tgatgcacagttcagcacctgttg

SEQ ID NO: 204 - DNA, 47 bp, Artificial Sequence
  Synthetic oligonucleotide probe
cgctccaagggctttgacgtcacagtgaagtacacacaaggaagctg

SEQ ID NO: 205 - DNA, 1939 bp, Homo sapiens
cgcctccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgtgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccaaaaaaaaaaaaaaaaaaaaa

SEQ ID NO: 206 - protein, 377 aa, Homo sapiens
MEALLLGAGLLLGAYVLVYYNLVKAPPCGGMGNLRGRTAVVTGANSGIGKMTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 207 - DNA, 24 bp, Artificial Sequence
  Synthetic oligonucleotide probe
cttcatggccttggacttggccag

SEQ ID NO: 208 - DNA, 24 bp, Artificial Sequence
  Synthetic oligonucleotide probe
acgccagtggcctcaagctggttg

SEQ ID NO: 209 - DNA, 45 bp, Artificial Sequence
  Synthetic oligonucleotide probe
ctttctgagctctgagccacggttggacatcctcatccacaatgc

SEQ ID NO: 210 - DNA, 3716 bp, Homo sapiens
ggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaaaaaaaaaaaaaaaaaaaaaaaaaaaaaaaaaaaaa

SEQ ID NO: 211 - protein, 985 aa, Homo sapiens
MGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 212 - DNA, 24 bp, Artificial Sequence
  Synthetic oligonucleotide probe
gaagggacctacatgtgtgtggcc

SEQ ID NO: 213 - DNA, 24 bp, Artificial Sequence
  Synthetic oligonucleotide probe
actgaccttccagctgagccacac

SEQ ID NO: 214 - DNA, 50 bp, Artificial Sequence
  Synthetic oligonucleotide probe
aggactacacggagcctgtggagcttctggctgtgcgaattcagctggaa

SEQ ID NO: 215 - DNA, 2749 bp, Homo sapiens
  unsure 1869, 1887: unknown base
ctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctggctctcacgcttgactgcggaggaaaaggaagccccttcccaggcccctgagggggacgtgatctcgatgcctcccctccacacatctgaggaggagctgggcttctcgaagtttgtctcagcgtagggcaggaggccctcctggccaggccagcagtgaagcagtatggctggctggatcagcaccgattcccgaaagctttccacctcagcctcagagtccagctgcccggactccagggctctccccaccctccccaggctctcctcttgcatgttccagcctgacctagaagcgtttgtcagccctggagcccagagcggtggccttgctcttccggctggagactgggacatccctgataggttcacatccctgggcagagtaccaggctgctgaccctcagcagggccagacaaggctcagtggatctggtctgagtttcaatctgccaggaactcctgggcctcatgcccagtgtcggaccctgccttcctcccactccagaccccaccttgtcttccctccctggcgtcctcagacttagtcccacggtctcctgcatcagctggtgatgaagaggagcatgctggggtgagactgggattctggcttctctttgaaccacctgcatccagcccttcaggaagcctgtgaaaaacgtgattcctggccccaccaagacccaccaaaaccatctctgggcttggtgcaggactctgaattctaacaatgcccagtgactgtcgcacttgagtttgagggccagtgggcctgatgaacgctcacaccccttcagcttagagtctgcatttgggctgtgacgtctccacctgccccaatagatctgctctgtctgcgacaccagatccacgtggggactcccctgaggcctgctaagtccaggccttggtcaggtcaggtgcacattgcaggataagcccaggaccggcacagaagtggttgcctttnccatttgccctccctggnccatgccttcttgcctttggaaaaaatgatgaagaaaaccttggctccttccttgtctggaaagggttacttgcctatgggttctggtggctagagagaaaagtagaaaaccagagtgcacgtaggtgtctaacacagaggagagtaggaacagggcggatacctgaaggtgactccgagtccagccccctggagaaggggtcgggggtggtggtaaagtagcacaactactattttttttctttttccattattattgttttttaagacagaatctcgtgctgctgcccaggctggagtgcagtggcacgatctgcaaactccgcctcctgggttcaagtgattcttctgcctcagcctcccgagtagctgggattacaggcacgcaccaccacacctggctaatttttgtacttttagtagagatggggtttcaccatgttggccaggctggtcttgaactcctgacctcaaatgagcctcctgcttcagtctcccaaattgccgggattacaggcatgagccactgtgtctggccctatttcctttaaaaagtgaaattaagagttgttcagtatgcaaaacttggaaagatggaggagaaaaagaaaaggaagaaaaaaatgtcacccatagtctcaccagagactatcattatttcgttttgttgtacttccttccactcttttcttcttcacataatttgccggtgttctttttacagagcaattatcttgtatatacaactttgtatcctgccttttccaccttatcgttccatcactttattccagcacttctctgtgttttacagacctttttataaataaaatgttcatcagctgcataaaaaaaaaaaaaa

SEQ ID NO: 216 - protein, 332 aa, Homo sapiens [sequence omitted]

SEQ ID NO: 217 - DNA, 24 bp, Artificial Sequence
  Synthetic oligonucleotide probe
ccctgcagtgcacctacagggaag

SEQ ID NO: 218 - DNA, 24 bp, Artificial Sequence
  Synthetic oligonucleotide probe
ctgtcttcccctgcttggctgtgg

SEQ ID NO: 219 - DNA, 47 bp, Artificial Sequence
  Synthetic oligonucleotide probe
ggtgcaggaagggtgggatcctcttctctcgctgctctggccacatc

SEQ ID NO: 220 - DNA, 950 bp, Homo sapiens
ttgtgactaaaagctggcctagcaggccagggagtgcagctgcaggcgtgggggtggcaggagccgcagagccagagcagacagccgagaaacaggtggacagtgtgaaagaaccagtggtctcgctctgttgcccaggctagagtgtactggcgtgatcatagctcactgcagcctcagactcctggacttgagaaatcctcctgccttagcctcctgcatatctgggactccaggggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaaa

SEQ ID NO: 221 - protein, 146 aa, Homo sapiens
MLLALVCLLSCLLPSSEAKLYGRCELARVLHDFGLDGYRGYSLADWVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 222 - DNA, 24 bp, Artificial Sequence
  Synthetic oligonucleotide probe
gggatcatgttgttggccctggtc

SEQ ID NO: 223 - DNA, 23 bp, Artificial Sequence
  Synthetic oligonucleotide probe
gcaaggcagacccagtcagccag

SEQ ID NO: 224 - DNA, 45 bp, Artificial Sequence
  Synthetic oligonucleotide probe
ctgcctgctaccctccaagtgaggccaagctctacggtcgttgtg

SEQ ID NO: 225 - DNA, 2049 bp, Homo sapiens
agccgctgccccgggccgggcgcccgcggcggcaccatgagtccccgctcgtgcctgcgttcgctgcgcctcctcgtcttcgccgtcttctcagccgccgcgagcaactggctgtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaagggactcgggaggcggccttcgtgtacgccatctcttcggcaggtgtggcctttgcagtgacgcgggcgtgcagcagtggggagctggagaagtgcggctgtgacaggacagtgcatggggtcagcccacagggcttccagtggtcaggatgctctgacaacatcgcctacggtgtggccttctcacagtcgtttgtggatgtgcgggagagaagcaagggggcctcgtccagcagagccctcatgaacctccacaacaatgaggccggcaggaaggccatcctgacacacatgcgggtggaatgcaagtgccacggggtgtcaggctcctgtgaggtaaagacgtgctggcgagccgtgccgcccttccgccaggtgggtcacgcactgaaggagaagtttgatggtgccactgaggtggagccacgccgcgtgggctcctccagggcactggtaccacgcaacgcacagttcaagccgcacacagatgaggacctggtgtacttggagcctagccccgacttctgtgagcaggacatgcgcagcggcgtgctgggcacgaggggccgcacatgcaacaagacgtccaaggccatcgacggctgtgagctgctgtgctgtggccgcggcttccacacggcgcaggtggagctggctgaacgctgcagctgcaaattccactggtgctgcttcgtcaagtgccggcagtgccagcggctcgtggagttgcacacgtgccgatgaccgcctgcctagccctgcgccggcaaccacctagtggcccagggaaggccgataatttaaacagtctcccaccacctaccccaagagatactggttgtattttttgttctggtttggtttttgggtcctcatgttatttattgccgaaaccaggcaggcaaccccaagggcaccaaccagggcctccccaaagcctgggcctttgtggctgccactgaccaaagggaccttgctcgtgccgctggctgcccgcatgtggctgccactgaccactcagttgttatctgtgtccgtttttctacttgcagacctaaggtggagtaacaaggagtattaccaccacatggctactgaccgtgtcatcggggaagagggggccttatggcagggaaaataggtaccgacttgatggaagtcacaccctctggaaaaaagaactcttaactctccagcacacatacacatggactcctggcagcttgagcctagaagccatgtctctcaaatgccctgagaaagggaacaagcagataccaggtcaagggcaccaggttcatttcagcccttacatggacagctagaggttcgatatctgtgggtccttccaggcaagaagagggagatgagagcaagagacgactgaagtcccaccctagaacccagcctgccccagcctgcccctgggaagaggaaacttaaccactccccagacccacctaggcaggcatataggctgccatcctggaccagggatcccggctgtgcctttgcagtcatgcccgagtcacctttcacagcgctgttcctccatgaaactgaaaaacacacacacacacacacacacacacacacacacacacacacacacggacacacacacacacctgcgagagagagggaggaaagggctgtgcctttgcagtcatgcccgagtcacctttcacagcactgttcctc

SEQ ID NO: 226 - protein, 351 aa, Homo sapiens
MSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 227 - DNA, 23 bp, Artificial Sequence
  Synthetic oligonucleotide probe
gctgcagctgcaaattccactgg

SEQ ID NO: 228 - DNA, 28 bp, Artificial Sequence
  Synthetic oligonucleotide probe
tggtgggagactgtttaaattatcggcc

SEQ ID NO: 229 - DNA, 41 bp, Artificial Sequence
  Synthetic oligonucleotide probe
tgcttcgtcaagtgccggcagtgccagcggctcgtggagtt

SEQ ID NO: 230 - DNA, 1355 bp, Homo sapiens
cggacgcgtgggcggacgcgtgggcggacgcgtgggcggacgcgtgggctgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacaactgctgaccccgcccagtgccctggagccgcgcccattgcagcatgtcgtatcctgggggctgctcacctccctggctcctggagctgattgccaaagagtttttttcttcctcatccaccgctgctgagtctcagaaacacttggcccaacatagccctgtccagcccagtgcctgggctctgggacctccatgccgacctcatcctaactccactcacgcagacccaacctaacctccactagctccaaaatccctgctcctgcgtccccgtgatatgcctccacttctctccctaaccaaggttaggtgactgaggactggagctgtttggttttctcgcattttccaccaaactggaagctgtttttgcagcctgaggaagcatcaataaatatttgagaaatgaaaaaa

SEQ ID NO: 231 - protein, 293 aa, Homo sapiens
MDTTRYSKWGGSSEEVPGGPWGRWVHWSRRPLFLALAVLVTTVLWAVILSILLSKASTERAALLDGHDLLRTNASKQTAALGALKEEVGDCHSCCSGTQAQLQTTRAELGEAQAKLMEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKRHNC

SEQ ID NO: 232 - DNA, 24 bp, Artificial Sequence
  Synthetic oligonucleotide probe
gcgagaactgtgtcatgatgctgc

SEQ ID NO: 233 - DNA, 24 bp, Artificial Sequence
  Synthetic oligonucleotide probe
gtttctgagactcagcagcggtgg

SEQ ID NO: 234 - DNA, 50 bp, Artificial Sequence
  Synthetic oligonucleotide probe
caccgtgtgacagcgagaaggacggctggatctgtgagaaaaggcacaac

SEQ ID NO: 235 - DNA, 1847 bp, Homo sapiens
gccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaaaaaaaaaaaaaaaaaaaaaaaaaaaaaaaaaaaaaaa

SEQ ID NO: 236 - protein, 331 aa, Homo sapiens [sequence omitted]

SEQ ID NO: 237 - DNA, 22 bp, Artificial Sequence
  Synthetic oligonucleotide probe
cagcactgccaggggaagaggg

SEQ ID NO: 238 - DNA, 18 bp, Artificial Sequence
  Synthetic oligonucleotide probe
caggactcgctacgtccg

SEQ ID NO: 239 - DNA, 24 bp, Artificial Sequence
  Synthetic oligonucleotide probe
cagccccttctcctcctttctccc

SEQ ID NO: 240 - DNA, 25 bp, Artificial Sequence
  Synthetic oligonucleotide probe
gcagttatcagggacgcactcagcc

SEQ ID NO: 241 - DNA, 18 bp, Artificial Sequence
  Synthetic oligonucleotide probe
ccagcgagaggcagatag

SEQ ID NO: 242 - DNA, 23 bp, Artificial Sequence
  Synthetic oligonucleotide probe
cggtcaccgtgtcctgcgggatg

SEQ ID NO: 243 - DNA, 42 bp, Artificial Sequence
  Synthetic oligonucleotide probe
cagccccttctcctcctttctcccacgtcctatctgcctctc

SEQ ID NO: 244 - DNA, 1894 bp, Homo sapiens
ggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacacctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacaaaaaaaaaaaaaaaaaaaaaaaaaaaaa

SEQ ID NO: 245 - protein, 472 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 246 - DNA, 24 bp, Artificial Sequence
  Synthetic oligonucleotide probe
tgcggagatcctactggcacaggg

SEQ ID NO: 247 - DNA, 18 bp, Artificial Sequence
  Synthetic oligonucleotide probe
cgagttagtcagagcatg

SEQ ID NO: 248 - DNA, 18 bp, Artificial Sequence
  Synthetic oligonucleotide probe
cagatggtgctgttgccg

SEQ ID NO: 249 - DNA, 29 bp, Artificial Sequence
  Synthetic oligonucleotide probe
caactggaacaggaactgagatgtggatc

SEQ ID NO: 250 - DNA, 24 bp, Artificial Sequence
  Synthetic oligonucleotide probe
ctggttcagcagtgcaagggtctg

SEQ ID NO: 251 - DNA, 18 bp, Artificial Sequence
  Synthetic oligonucleotide probe
cctctccgattaaaacgc

SEQ ID NO: 252 - DNA, 45 bp, Artificial Sequence
  Synthetic oligonucleotide probe
gagaggactggttgccatggcaaatgctggttctcatgataatgg

SEQ ID NO: 253 - DNA, 2456 bp, Homo sapiens
cgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctggatggagtctcgctctgtcgccaggctggagtgcagtggcacgatctcggctcactgcaacctccgcctcccgggttcaagcgagtctcctgcctcagcctctgagtgtctggggctacaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttataatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgttcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagaaaaaaaaaaa

SEQ ID NO: 254 - protein, 545 aa, Homo sapiens
MSTGFSFGSGTLGSTTVAAGGTSTGGVFSFGTGTSSNPSVGLNFGNLGSTSTPATTSAPSSGFGTGLFGSKPATGFTLGGTNTGALHTKRPQVVTKYGTLQGKQMHVGKTPIQVFLGVPFSRPPLGILRFAPPEPPEPWKGIRDATTYPPGWSLALSPGWSAVARSRLTATSASRVQASLLPQPLSVWGYRCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYNITKEQVPLVVEEYLDNVNEHDWKMLRNRMMDIVQDATFVYATLQTAHYHRETPMMGICPAGHATTRMKSTCSWILPQEWA

SEQ ID NO: 255 - DNA, 23 bp, Artificial Sequence
  Synthetic oligonucleotide probe
aggtgcctgcaggagtcctgggg

SEQ ID NO: 256 - DNA, 24 bp, Artificial Sequence
  Synthetic oligonucleotide probe
ccacctcaggaagccgaagatgcc

SEQ ID NO: 257 - DNA, 45 bp, Artificial Sequence
  Synthetic oligonucleotide probe
gaacggtacaagtggctgcgcttcagcgaggactgtctgtacctg

SEQ ID NO: 258 - DNA, 2764 bp, Homo sapiens
gagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaagactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgacatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcctccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcaccttaaaaaaa

SEQ ID NO: 259 - protein, 544 aa, Homo sapiens [sequence omitted]

SEQ ID NO: 260 - DNA, 22 bp, Artificial Sequence
  Synthetic oligonucleotide probe
caaagcctgcgcctggtctgtg

SEQ ID NO: 261 - DNA, 24 bp, Artificial Sequence
  Synthetic oligonucleotide probe
ttctggagcccagagggtgctgag

SEQ ID NO: 262 - DNA, 45 bp, Artificial Sequence
  Synthetic oligonucleotide probe
ggagctgccacccattcaaatggagcacgaaggagagttcacctg

SEQ ID NO: 263 - DNA, 2857 bp, Homo sapiens
tgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagttatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatgtaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaa

SEQ ID NO: 264 - protein, 772 aa, Homo sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 265 - DNA, 349 bp, Homo sapiens
  unsure 24, 60, 141, 226, 228, 249, 252: unknown base
atttcaaggccagccatatttttntgttgaaccaacaacaggagtcataagaatattttntaaaatggatagagaactgcaagatgagtattgggtaatcattcaagccaaggacatgattggtcagccaggagcgttgtntggaacaacaagtgtattaattaaactttcagatgttaatgacaataagcctatatttaaagaaagtttataccgcttgactgtntntgaatctgcacccactggganttntataggaacaatcatggcatatgataatgacataggagagaatgcagaaatggattacagcattgaagaggatgattcgcaaacatttgacattatt

SEQ ID NO: 266 - DNA, 25 bp, Artificial Sequence
  Synthetic oligonucleotide probe
cttgactgtctctgaatctgcaccc

SEQ ID NO: 267 - DNA, 24 bp, Artificial Sequence
  Synthetic oligonucleotide probe
aagtggtggaagcctccagtgtgg

SEQ ID NO: 268 - DNA, 52 bp, Artificial Sequence
  Synthetic oligonucleotide probe
ccactacggtattagagcaaaagttaaaaaccatcatggttcctggagcagc

SEQ ID NO: 269 - DNA, 2747 bp, Homo sapiens
gcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcccccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactcttattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaataaaaaaaatgttaag

SEQ ID NO: 270 - protein, 211 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 271 - DNA, 564 bp, Homo sapiens
  unsure 21, 69, 163, 434, 436, 444: unknown base
ttctggccaaacccggggctncagctgttgggcttcatctcgccttcctgggatggatcggcgccatcntcacactgcccttccccagtggaggattttactccctatgctggcgacaacatcgtgaccgcccagcccatgtacgaggggctgtggatgtccngcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaancnttcaacanttctatgaccctatgaccccagtcaatgccaggtacgaatttggtcaggctctcttcactggctgggctgctgcttctctctgccttctgggaggtgccctactttgctgttcctgtccc

SEQ ID NO: 272 - DNA, 498 bp, Homo sapiens
  unsure 30, 49, 102, 141, 147, 171, 324-325, 339-341: unknown base
acccttgacccaacgcggccccccgaccgnttcatggccaaacgcgggnctccagctgttgggcttcattctccccttcctgggatggaccggcgcccatcntcagcactgccctgccccagtggaggatttactcctatnccggcnacaacatcgtgaccgcccaggccntgtacgaggggctgtggatgtcctgcgtgtcgcagagcaccgggcagatccagtgcaaagtctttgactcccttgctgaatctgagcagcacattgcaagcaacccgtgccttgatggtggttggcatcctcctgggagtgatagcaatcttnntggccaccgttgtnnntgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccga

SEQ ID NO: 273 - DNA, 552 bp, Homo sapiens
  unsure 25, 57, 67, 94-95, 116, 152, 165, 212, 233, 392-394: unknown base
gggcccgaccattatccaaccgggntcactgttggctcatctccctcctggatgaancgcgccatcntcagactccctgccccatggagatttnncctatgctggcgacaacatcntgacccccagccatgtacgaggggctttgaacgtcngcgtgtcgcagancaccgggcagatccagtgcaaagtctttgactccttgctgaatctgngcagcacattgcagcaacccntgccctgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctatttnnngttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgcga

SEQ ID NO: 274 - DNA, 526 bp, Homo sapiens
  unsure 25, 50, 60, 123, 127, 370, 395, 397-398, 402-403, 405-407: unknown base
attctcccctcctggatggatcgcnccaccgtcacattgccttcccccantggaggattnactcctatgctggcgacaacatcgtgaccccccaggccatttaccgaggggctttggatgtcntgcntgtcgcagagcaccgggcagatcccagtgcaaagtctttgactccttgctgaatctgagcagcacattgcaagcaacccgtgccttgatggggttggcatcctcctgggagtgatagcaacctttgtggccaccgttggcatgaagtgtatgaagtgcttggaagacgatgaggtgccagaagatgaggatggctgtcattgggggcgcgatatttcttgttgcaggtctggctattttagtngccacagcatggtatggcaatagantnnttcnngnnntctatgaccctatgaccccagtcaatgccaggtacgaatttggtcaggctctcttcactggctgggctgctgcttctctctgccttctgggaggtgccctactttgctgttcctgtccc

SEQ ID NO: 275 - DNA, 398 bp, Homo sapiens
  unsure 22, 61, 91, 144, 238-239, 262, 265-266, 271, 274: unknown base
agagcaccggcagatcccagtncaaagtctttgacccttgctgaatctgagcagcacattncaagcaaccccttgccttgaaggtggttgncatcccccctgggagtgaatagcaatctttgtggccaccgttggcatgaagtntatgaagtgcttggaagacgatgaggtgcagaagatgaggatggctgtcattgggggcgcgatatttcttcttgcaggtctggctattttagtnnccacagcatggtatggcaatagnatnnttcgnggnttctatgaccctatgaccccagtcaatgccaggtacgaatttggtcaggctctcttcactggctgggctgctgcttctctctgccttctgggaggtgccctactttgctgttcctgtccccgaa

SEQ ID NO: 276 - DNA, 495 bp, Homo sapiens
  unsure 39, 58, 130, 234, 314, 364, 427, 450, 461, 476: unknown base
agcaatgccctgcccccagtggaggattaattcctatgntggggacaacattgtgacngcccaggccatgtacggggggctgtggatgtcctgcgtgtcgcagagcaccgggcagatccagtgcaaagtntttgactccttgctgaatttgagcagcacattgcaagcaacccgtgccttgatggtggttggcatcttcctgggagtgatagcaatctttgtggccaccgtggnaatgaagtgtatgaagtgcttggaagacgatgaggtgcagaagatgaggatggctgtcattgggggcgcgatatttcttnttgcaggtctggctattttagttgccacagcatggtatggcaatagaatngttcaagaattttatgaccctatgaccccagtcaatgccaggtacgaatttggtcaggctttnttcactggctgggctgctgcttntttctgccttntgggaggtgccctantttgctgttcctgcgaacc

SEQ ID NO: 277 - DNA, 200 bp, Homo sapiens
  unsure 34, 87, 138, 147, 163, 165-166, 172: unknown base
tcataggggggcgcgatattttttcttgcaggtntggttattttagttgccacagcatggtatggcaatagaatcgttcaagaattntatgaccctatgaccccagtcaatgccaggtacgaatttggtcaggctctnttcactggntgggctgctgcttctntnngccttntgggaggtgccctactttgctgttcctg

SEQ ID NO: 278 - DNA, 542 bp, Homo sapiens
  unsure 26, 43, 55, 77, 198, 361-362, 391-392, 396: unknown base
ttcctgggatggatccgcccccatcntcacatgccctgccccntggagatttacncctatgctggcgaacaacatcntgaccgcccaggccatgtacgaggggctgtggaatgtcctgcgtgtcccagagcaccgggcagatccagtgcaaagtctttgactccttgctgaatctgagcagcacattgcaagcaaccntgccttgatggtggttggcatcctcctgggagtgatagcaatctttgtggccaccgttggcatgaaagtgtatgaagtgcttggaagacgatgaggtgcagaagatgaggatggctgtcattgggggcgcgatatttcttcttgcaggtctggctattttagnngccacagcatggtatggcaatcagacccnntcanaaactctatgaccctatgaccccagtcaatgccaggtacgaatttggtcaggctctcttcactggctgggctgctgcttctctctgccttctgggaggtgccctactttgctgttcctgtccccgaaaaacaacctcttacccacg

SEQ ID NO: 279 - DNA, 548 bp, Homo sapiens
  unsure 90, 115, 147, 228, 387: unknown base
cggggctgcagctgttgggcttcatctcgcttcctgggatggaatcggcgccatcgtcagcactgccctgccccatggaggatttactcntatgctggcgacaacatcgtgaccncccaggccatgtacgaggggctgtggatgtcngcgtgtcgcagagcaccgggcagatccagtgcaaagtctttgactccttgctgaatctgagcagcacattgcaagcaaccntgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctatttntagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgcgaa

SEQ ID NO: 280 - DNA, 21 bp, Artificial Sequence
  Synthetic oligonucleotide probe
cgagcgagtcatggccaacgc

SEQ ID NO: 281 - DNA, 26 bp, Artificial Sequence
  Synthetic oligonucleotide probe
gtgtcacacgtagtctttcccgctgg

SEQ ID NO: 282 - DNA, 43 bp, Artificial Sequence
  Synthetic oligonucleotide probe
ctgcagctgttgggcttcattctcgccttcctgggatggatcg

SEQ ID NO: 283 - DNA, 2285 bp, Homo sapiens
gcgtgccgtcagctcgccgggcaccgcggcctcgccctcgccctccgcccctgcgcctgcaccgcgtagaccgacccccccctccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaaaa

SEQ ID NO: 284 - protein, 243 aa, Homo sapiens
MAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPHDVEINKIISTTASKTETPIVSKSLSSSLDDTEVKKVMEECKRLQGEVQRLREENKQFKEEDGLRMRKTVQSNSPISALAPTGKEEGLSTRLLALVVLFFIVGVIIGKIAL

SEQ ID NO: 285 - DNA, 418 bp, Homo sapiens
  unsure 40, 53, 68, 119, 134, 177-178, 255: unknown base
gtcagtcttctagattgtccttatcccacctttcaaccantactcacatttcnagcgcccaggtccangtctgagcctgacttccccttggggacctagcctggagtcaggacaatggntcgggctgcagaggnttagaagcgagggcaccagcagttttgggtggggagcaagggnngagagaaactcttcagcgaatccttctagtactagttgagagtttgactgtgaattaattttatgccataaaagacnaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagc

SEQ ID NO: 286 - DNA, 543 bp, Homo sapiens
  unsure 73, 97: unknown base
tattgtaaaggccattttaaaccattggtaggccttggtacatgatgctggattacctccttaaatgacaccnttcctcgcctgttggtgctggccnttggggagctggagccccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgccactgtggcagcatcagacgtactcgtcataagtgagaggcgtgtgttgactgattgacccagcgctttggaaataaatggcagtgctttgttcacttaaagggaccaagctaaattgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctg

SEQ ID NO: 287 - DNA, 270 bp, Homo sapiens
  unsure 38, 64, 72, 164, 198, 200, 220, 222, 229, 242: unknown base
ccctggtggttttgttctttaattcgttggtgtaattnttgggaagattgcttgtagaggtagnatgcaccnggctggtaaattggattggtggatccaccatatccatgggatttaaatttatcataaccatgtgtaaaaagaaattaatgtatgatgacatntcacaggtattgcctttaaattacccatccctgnanacacatacacagatacacananacaaatntaatgtaacgatnttttagaaagttaaaaatgtatagtaac

SEQ ID NO: 288 - DNA, 428 bp, Homo sapiens
  unsure 35, 116, 129, 197, 278, 294, 297, 349, 351: unknown base
ggtggcccattcccggcccaggctgctttccggtnttcagttctgtccaagccatcagctccttgggactgatgaacagagtcagaagcccaaaggaattgcactgtggcagcatnagacgtacttgtnataagtgagaggcgtgtgttgactgattgacccagcgctttggaaataaatggcagtgctttgttcanttaaagggaccaagctaaatttgtattggttcatgtagtgaagtcaaactgttattcagagatgtttaatgcatatttaanttatttaatgtatttnatntcatgttttcttattgtcacaagagtacagttaatgctgcgtgctgctgaantntgttgggtgaactggtattgctgctggagggctgtgggctcctctgtctttggagagtctggtcatgtggaggtggg

SEQ ID NO: 289 - DNA, 320 bp, Homo sapiens
tgctttccgtgtcttcagttctgtccaagccatcagctccttgggacttgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgc

SEQ ID NO: 290 - DNA, 609 bp, Homo sapiens
  unsure 57, 60, 186, 235, 244, 304, 339, 355, 359, 361, 387, 432, 441,447, 481, 513, 532, 584, 598: unknown base
aaacctttaaaagttgaggggaaaagaatgatcctttattaatgacaagggaaaccntgngtaatgccacaatggcatattgtaaatgtcattttaaacattggtaggccttggtacatgatgctggattacctctcttaaaatgacacccttcctcgcctgttggtgctggcccttggggagctngagcccagcatgctggggagtgcggtctgctccacacagtagtccccangtggcccantcccggcccaggctgctttccgtgtcttcagttctgtccaagccatcagctccttgggantgatgaacagagtcagaagcccaaaggaattgcantgtggcagcatcagangtantngtcataagtgagaggcgtgtgttgantgattgacccagcgctttggaaataaatggcagtgctttgttcanttaaagggnccaagntaaatttgtattggttcatgtagtgaagtcaaantgttattcagagatgtttaatgcatatttaanttatttaatgtatttcatntcatgttttcttattgtcacaagggtacagttaatgctgcgtgctgctgaantctgttgggtgaantggtattgctg

SEQ ID NO: 291 - DNA, 493 bp, Homo sapiens
ggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggg

SEQ ID NO: 292 - DNA, 27 bp, Artificial Sequence
  Synthetic oligonucleotide probe
gcaccaccgtaggtacttgtgtgaggc

SEQ ID NO: 293 - DNA, 23 bp, Artificial Sequence
  Synthetic oligonucleotide probe
aaccaccagagccaagagccggg

SEQ ID NO: 294 - DNA, 50 bp, Artificial Sequence
  Synthetic oligonucleotide probe
cagcggaatcatcgatgcaggggcctcaattaatgtatctgtgatgttac

SEQ ID NO: 295 - DNA, 2530 bp, Homo sapiens
gcgagctccgggtgctgtggcccggccttggcggggcggcctccggctcaggctggctgagaggctcccagctgcagcgtccccgcccgcctcctcgggagctctgatctcagctgacagtgccctcggggaccaaacaagcctggcagggtctcactttgttgcccaggctggagttcagtgccatgatcatggtttactgcagccttgacctcctgggttcaagcgatcctgctgagtagctgggactacaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcaggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatga

SEQ ID NO: 296 - protein, 413 aa, Homo sapiens
MENMLLWLIFFTPGWTLIDGSEMEWDFMWHLRKVPRIVSERTFHLTSPAFEADAKMMVNTVCGIECQKELPTPSLSELEDYLSYETVFENGTRTLTRVKVQDLVLEPTQNITTKGVSVRRKRQVYGTDSRFSILDKRFLTNFPFSTAVKLSTGCSGILISPQHVLTAAHCVHDGKDYVKGSKKLRVGLLKMRNKSGGKKRRGSKRSRREASGGDQREGTREHLQERAKGGRRRKKSGRGQRIAEGRPSFQWTRVKNTHIPKGWARGGMGDATLDYDYALLELKRAHKKKYMELGISPTIKKMPGGMIHFSGFDNDRADQLVYRFCSVSDESNDLLYQYCDAESGSTGSGVYLRLKDPDKKNWKRKIIAVYSGHQWVDVHGVQKDYNVAVRITPLKYAQICLWIHGNDANCAYG

SEQ ID NO: 297 - DNA, 24 bp, Artificial Sequence
  Synthetic oligonucleotide probe
gcatctgcaggagagagcgaaggg

SEQ ID NO: 298 - DNA, 24 bp, Artificial Sequence
  Synthetic oligonucleotide probe
catcgttcccgtgaatccagaggc

SEQ ID NO: 299 - DNA, 45 bp, Artificial Sequence
  Synthetic oligonucleotide probe
gaagggaggccttcctttcagtggacccgggtcaagaatacccac

SEQ ID NO: 300 - DNA, 1869 bp, Homo sapiens
aatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggaggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcacttccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgtaagttgtaaaagcacagactgttctatatttgaaactgttttgtttaaagaaagcagtgtctcactggttgtagctttcatgggttctgaactaagtgtaatcatctcaccaaagctttttggctctcaaattaaagattgattagtttcaaaaaaaaaaa

SEQ ID NO: 301 - protein, 525 aa, Homo sapiens [sequence omitted]

SEQ ID NO: 302 - DNA, 1533 bp, Homo sapiens
cggacgcgtgggcggcggctgcggaactcccgtggaggggccggtgggccctcgggcctgacagatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtac

SEQ ID NO: 303 - protein, 336 aa, Homo sapiens
MAVATAAAVLAALGGALWLAARRFVGPRVQRLRRGGDPGLMHGKTVLITGANSGLGRATAAELLRLGARVIMGCRDRARAEEAAGQLRRELRQAAECGPEPGVSGVGELIVRELDLASLRSVRAFCQEMLQEEPRLDVLINNAGIFQCPYMKTEDGFEMQFGVNHLGHFLLTNLLLGLLKSSAPSRIVVVSSKLYKYGDINFDDLNSEQSYNKSFCYSRSKLANILFTRELARRLEGTNVTVNVLHPGIVRTNLGRHIHIPLLVKPLFNLVSWAFFKTPVEGAQTSIYLASSPEVEGVSGRYFGDCKEEELLPKAMDESVARKLWDISEVMVGLLK

SEQ ID NO: 304 - DNA, 521 bp, Homo sapiens
  unsure 20, 34, 62, 87, 221, 229: unknown base
ggggattgtaaagaggaagnactgtgcccaaagntatggatgaatctgttgcaagaaaattntgggatatcagtgaagtgatggttngcctgctaaaataggaacaaggagtaaaagagctgtttataaaactgcatatcagttatatctgtgatcaggaatggtgtggattgagaacttgttacttgaagaaaaagaattttgatattggaatagcctgntaagaggnacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggctt

SEQ ID NO: 305 - DNA, 24 bp, Artificial Sequence
  Synthetic oligonucleotide probe
ccaggaaatgctccaggaagagcc

SEQ ID NO: 306 - DNA, 26 bp, Artificial Sequence
  Synthetic oligonucleotide probe
gcccatgacaccaaattgaagagtgg

SEQ ID NO: 307 - DNA, 45 bp, Artificial Sequence
  Synthetic oligonucleotide probe
aacgcagggatcttccagtgcccttacatgaagactgaagatggg

SEQ ID NO: 308 - DNA, 1523 bp, Homo sapiens
gagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgctacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaatttaaaaaaaaaaaaaaaaaaaaaaaaaaaaaaaaaaaaaaaaaaaaa

SEQ ID NO: 309 - protein, 406 aa, Homo sapiens [sequence omitted]

SEQ ID NO: 310 - DNA, 182 bp, Homo sapiens
  unsure 36, 48: unknown base
attaaggaagaatttccaaatgaaaatcaagtagtntttgccagagtngattgtgatcagcactctgacatagcccagagatacaggataagcaaatacccaaccctcaaattgtttcgtaatgggatgatgatgaagagagaatacaggggtcagcgatcagtgaaagcattggcagatta

SEQ ID NO: 311 - DNA, 598 bp, Homo sapiens
  unsure 38, 59, 140, 169, 174, 183, 282-283, 294-295, 319, 396: unknown base
agaggcctctctggaagttgtcccgggtgttcgccgcnggagcccgggtcgagaggacnaggtgccgctgcctggagaatcctccgctgccgtcggctcccggagcccagccctttcctaacccaacccaacctagcccngtcccagccgccagcgcctgtccctgtcncggancccagcgtnaccatgcatcctgccgtcttcctatccttacccgacctcagatgctcccttctgctcctggtaacttgggtttttactcctgtaacaactgaaataacnngtcttgatacnnagaatatagatgaaattttaaacnatgctgatgtggctttagtcaatttttatgctgactggtgtcgtttcagtcagatgtggcatccaatttttgaggangcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggc

SEQ ID NO: 312 - DNA, 22 bp, Artificial Sequence
  Synthetic oligonucleotide probe
tgagaggcctctctggaagttg

SEQ ID NO: 313 - DNA, 19 bp, Artificial Sequence
  Synthetic oligonucleotide probe
gtcagcgatcagtgaaagc

SEQ ID NO: 314 - DNA, 20 bp, Artificial Sequence
  Synthetic oligonucleotide probe
ccagaatgaagtagctcggc

SEQ ID NO: 315 - DNA, 20 bp, Artificial Sequence
  Synthetic oligonucleotide probe
ccgactcaaaatgcattgtc

SEQ ID NO: 316 - DNA, 19 bp, Artificial Sequence
  Synthetic oligonucleotide probe
catttggcaggaattgtcc

SEQ ID NO: 317 - DNA, 18 bp, Artificial Sequence
  Synthetic oligonucleotide probe
ggtgctataggccaaggg

SEQ ID NO: 318 - DNA, 24 bp, Artificial Sequence
  Synthetic oligonucleotide probe
ctgtatctctgggctatgtcagag

SEQ ID NO: 319 - DNA, 25 bp, Artificial Sequence
  Synthetic oligonucleotide probe
ctacatataatggcacatgtcagcc

SEQ ID NO: 320 - DNA, 46 bp, Artificial Sequence
  Synthetic oligonucleotide probe
cgtcttcctatccttacccgacctcagatgctcccttctgctcctg

SEQ ID NO: 321 - DNA, 1333 bp, Homo sapiens
gcccacgcgtccgatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactc

SEQ ID NO: 322 - protein, 144 aa, Homo sapiens
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 323 - DNA, 477 bp, Homo sapiens
attatagcatttgatgagctgaagactgattacaagatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatg

SEQ ID NO: 324 - DNA, 43 bp, Artificial Sequence
  Synthetic oligonucleotide probe
tgtaaaacgacggccagttaaatagacctgcaattattaatct

SEQ ID NO: 325 - DNA, 41 bp, Artificial Sequence
  Synthetic oligonucleotide probe
caggaaacagctatgaccacctgcacacctgcaaatccatt

SEQ ID NO: 326 - DNA, 20 bp, Artificial Sequence
  Synthetic oligonucleotide probe
gtgcagcagagtggcttaca

SEQ ID NO: 327 - DNA, 20 bp, Artificial Sequence
  Synthetic oligonucleotide probe
actggaccaattcttctgtg

SEQ ID NO: 328 - DNA, 45 bp, Artificial Sequence
  Synthetic oligonucleotide probe
gatattctagcatattgtcagaaggaaggatggtgcaaattagct

SEQ ID NO: 329 - DNA, 1174 bp, Homo sapiens
cggacgcgtgggggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtg

SEQ ID NO: 330 - protein, 323 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 331 - DNA, 350 bp, Homo sapiens
ttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgc

SEQ ID NO: 332 - DNA, 562 bp, Homo sapiens
  unsure 47: unknown base
cacactggccggatcttttagagtcctttgaccttgaccaagggtcnggaaaacagcaacaagctgagctgctgtgacagagggaacaagatggcggcgccgaagggagcctttgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgc

SEQ ID NO: 333 - DNA, 22 bp, Artificial Sequence
  Synthetic oligonucleotide probe
acaagctgagctgctgtgacag

SEQ ID NO: 334 - DNA, 22 bp, Artificial Sequence
  Synthetic oligonucleotide probe
tgattctggcaaccaagatggc

SEQ ID NO: 335 - DNA, 40 bp, Artificial Sequence
  Synthetic oligonucleotide probe
atggccttggccggaggttcggggaccgcttcggctgaag

SEQ ID NO: 336 - DNA, 1885 bp, Homo sapiens
gcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattaaaaaaaaaaaaaaaaaaaaaaaaaaaaaaaaaaaaaaa

SEQ ID NO: 337 - protein, 468 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 338 - DNA, 507 bp, Homo sapiens
  unsure 101, 263, 376, 397, 426: unknown base
gctggaaatatggatgtcatctacgagaaactgttttaagccacagacaattaaaagacctttaaatcctttggcttctggtcaagggacaagtgaagagnacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttnaacagcgatttgatggaattttgactgaaggagaaggtccaagaaggcttaagaacttgtattttctctacttaatagaactaagggctttatccaaagtgttaccattcttngagcgcccagattttcaactntttactggaaataaaattcaggatgaggnaaacaaaatgttacttttggaaatacttcatgaaatcaagtcatttcctttgcattttgatgagaattcatttttttgctg

SEQ ID NO: 339 - DNA, 20 bp, Artificial Sequence
  Synthetic oligonucleotide probe
aagctgccggagctgcaatg

SEQ ID NO: 340 - DNA, 21 bp, Artificial Sequence
  Synthetic oligonucleotide probe
ttgcttcttaatcctgagcgc

SEQ ID NO: 341 - DNA, 20 bp, Artificial Sequence
  Synthetic oligonucleotide probe
aaaggaggactttcgactgc

SEQ ID NO: 342 - DNA, 26 bp, Artificial Sequence
  Synthetic oligonucleotide probe
agagattcatccactgctccaagtcg

SEQ ID NO: 343 - DNA, 25 bp, Artificial Sequence
  Synthetic oligonucleotide probe
tgtccagaaacaggcacatatcagc

SEQ ID NO: 344 - DNA, 50 bp, Artificial Sequence
  Synthetic oligonucleotide probe
agacagcggcacagaggtgcttctgccaggttagtggttacttggatgat

SEQ ID NO: 345 - DNA, 1486 bp, Homo sapiens
cggacgcgtgggcggacgcgtgggcggacgcgtgggttgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagaaagaccccatctctaaataaatgttttaaaaat

SEQ ID NO: 346 - protein, 124 aa, Homo sapiens
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMVS

SEQ ID NO: 347 - DNA, 509 bp, Homo sapiens
  unsure 22: unknown base
cacagttccccaccatcactcntcccattccttccaactttatttttagcttgccattgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgg

SEQ ID NO: 348 - DNA, 23 bp, Artificial Sequence
  Synthetic oligonucleotide probe
agggacagaggccagaggacttc

SEQ ID NO: 349 - DNA, 24 bp, Artificial Sequence
  Synthetic oligonucleotide probe
caggtgcatattcacagcaggatg

SEQ ID NO: 350 - DNA, 45 bp, Artificial Sequence
  Synthetic oligonucleotide probe
ggaactccccttcgtcactcacctgttcttgcccctggtgttcct

SEQ ID NO: 351 - DNA, 2056 bp, Homo sapiens
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtaaaaaaaaaaaaaaaa

SEQ ID NO: 352 - protein, 311 aa, Homo sapiens
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 353 - DNA, 864 bp, Homo sapiens
  unsure 654, 711, 748, 827: unknown base
tcctgctgatgcacatctgggtttggcaaaaggaggttgcttcgagccgccctttctagcttcctggccggctctagaacaattcaggcttcgctgcgactagacctcagctccaacatatgcattctgaagaaagatggctgagatgacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaacctttgtgtcagggccacattgggctcacagacctcagcctggagcatcctgaagcatccctttaatagaaactcaaccatccttacccgacctgggatggagatcaccaaagatggcttncacctggttattgagctggaggacctggggccccagtttgagttccttgtggcctantggaggaggggcgaaccccttgcggcgcaaggggttngcgaaccccttgcggccgctggggtatctctcgagaaaagagaggcccaatatgacccacatactcaatatggacgaantgctattgtccacctgtttgagtggcgctgggttgat

SEQ ID NO: 354 - DNA, 23 bp, Artificial Sequence
  Synthetic oligonucleotide probe
aggcttcgctgcgactagacctc

SEQ ID NO: 355 - DNA, 24 bp, Artificial Sequence
  Synthetic oligonucleotide probe
ccaggtcgggtaaggatggttgag

SEQ ID NO: 356 - DNA, 50 bp, Artificial Sequence
  Synthetic oligonucleotide probe
tttctacgcattgattccatgtttgctcacagatgaagtggccattctgc

SEQ ID NO: 357 - DNA, 1670 bp, Homo sapiens
cccacgcgtccgcccacgcgtccgagggacaagagagaagagagactgaaacagggagaagaggcaggagaggaggaggtggggagagcacgaagctggaggccgacactgagggagggcgggaggaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgtgggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatactta

SEQ ID NO: 358 - protein, 328 aa, Homo sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 359 - DNA, 24 bp, Artificial Sequence
  Synthetic oligonucleotide probe
tctgctgaggtgcagctcattcac

SEQ ID NO: 360 - DNA, 24 bp, Artificial Sequence
  Synthetic oligonucleotide probe
gaggctctggaagatctgagatgg

SEQ ID NO: 361 - DNA, 50 bp, Artificial Sequence
  Synthetic oligonucleotide probe
gcctctttgtcaacgttgccagtacctctaacccattcctcagtcgcctc

SEQ ID NO: 362 - DNA, 3038 bp, Homo sapiens
ggcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgattttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaaaaaaaaaaaa

SEQ ID NO: 363 - protein, 500 aa, Homo sapiens
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 364 - DNA, 24 bp, Artificial Sequence
  Synthetic oligonucleotide probe
ggacagaatttgggagcacactgg

SEQ ID NO: 365 - DNA, 20 bp, Artificial Sequence
  Synthetic oligonucleotide probe
ccaagagtatactgtcctcg

SEQ ID NO: 366 - DNA, 25 bp, Artificial Sequence
  Synthetic oligonucleotide probe
agcacagattttctctacagccccc

SEQ ID NO: 367 - DNA, 24 bp, Artificial Sequence
  Synthetic oligonucleotide probe
aaccactccagcatgtactgctgc

SEQ ID NO: 368 - DNA, 50 bp, Artificial Sequence
  Synthetic oligonucleotide probe
ccattcaggtgttctggccctgtatgtacacattatacacaggtcgtgtg

SEQ ID NO: 369 - DNA, 1685 bp, Homo sapiens
gcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaaaaaaaaaaaaaaa

SEQ ID NO: 370 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 371 - DNA, 22 bp, Artificial Sequence
  Synthetic oligonucleotide probe
cagcgccctccccatgtccctg

SEQ ID NO: 372 - DNA, 24 bp, Artificial Sequence
  Synthetic oligonucleotide probe
tcccaactggtttggagttttccc

SEQ ID NO: 373 - DNA, 45 bp, Artificial Sequence
  Synthetic oligonucleotide probe
ctccggtcagcatgaggctcctggcggccgctgctcctgctgctg

SEQ ID NO: 374 - DNA, 3113 bp, Homo sapiens
gccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatggagccaacacaaagaaaaacgcagatgatataacgagtaatgaccgtggtgaagacgaagatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcaatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgt

SEQ ID NO: 375 - protein, 816 aa, Homo sapiens
MLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDGANTKKNADDITSNDRGEDEDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVAADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 376 - DNA, 25 bp, Artificial Sequence
  Synthetic oligonucleotide probe
ggcaagctacggaaacgtcatcgtg

SEQ ID NO: 377 - DNA, 25 bp, Artificial Sequence
  Synthetic oligonucleotide probe
aacccccgagccaaaagatggtcac

SEQ ID NO: 378 - DNA, 47 bp, Artificial Sequence
  Synthetic oligonucleotide probe
gtaccggtgaccaggcagcaaaaggcaactatgggctcctggatcag

SEQ ID NO: 379 - DNA, 2461 bp, Homo sapiens
gggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaaaaaaaaaaaaaaaagggcggccgcgactctagagtcgacctgcagtagggataacagggtaataagcttggccgccatgg

SEQ ID NO: 380 - protein, 348 aa, Homo sapiens
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 381 - DNA, 22 bp, Artificial Sequence
  Synthetic oligonucleotide probe
ccttgggtcgtggcagcagtgg

SEQ ID NO: 382 - DNA, 24 bp, Artificial Sequence
  Synthetic oligonucleotide probe
cactctccaggctgcatgctcagg

SEQ ID NO: 383 - DNA, 45 bp, Artificial Sequence
  Synthetic oligonucleotide probe
gtcaaacgttcgagtacttgaaacgggagcactcgctgtcgaagc

SEQ ID NO: 384 - DNA, 3150 bp, Homo sapiens
ccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagtgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccagacaaaacagatggtgaccagacttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattaggtagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaataa

SEQ ID NO: 385 - protein, 480 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 386 - DNA, 24 bp, Artificial Sequence
  Synthetic oligonucleotide probe
ccaagcagcttagagctccagacc

SEQ ID NO: 387 - DNA, 25 bp, Artificial Sequence
  Synthetic oligonucleotide probe
ttccctatgctctgtattggcatgg

SEQ ID NO: 388 - DNA, 50 bp, Artificial Sequence
  Synthetic oligonucleotide probe
gccacttctgccacaatgtcagctttccctgtaccagaaatggctgtgtt

SEQ ID NO: 389 - DNA, 3313 bp, Homo sapiens
aaaaaagctcactaaagtttctattagagcgaatacggtagatttccatccccttttgaagaacagtactgtggagctatttaagagataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttctttttttttttaattgctctgtctcccaagctggagtgcagcggtacgatcatagctcactgcggcctcaaactcctaggctcaagcaattatcccacctttgcctccggtgtaacagggactacaggtgcaagccacctactgtctgcctatctatctatctatctatctatctatctatctatctatctatctatctattactttcttgtacagacgggagtctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctca

SEQ ID NO: 390 - protein, 916 aa, Homo sapiens
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEVSLYQIFFLFFFNCSVSQAGVQRYDHSSLRPQTPRLKQLSHLCLRCNRDYRCKPPTVCLSIYLSIYLSIYLSIYLLLSCTDGSLTPVIPVLWEAEAGGSPEVGSLRPA

SEQ ID NO: 391 - DNA, 23 bp, Artificial Sequence
  Synthetic oligonucleotide probe
tccgtctctgtgaaccgccccac

SEQ ID NO: 392 - DNA, 24 bp, Artificial Sequence
  Synthetic oligonucleotide probe
ctcgggcgcattgtcgttctggtc

SEQ ID NO: 393 - DNA, 40 bp, Artificial Sequence
  Synthetic oligonucleotide probe
ccgactgtgaaagagaacgccccagatccacttgttcccc

SEQ ID NO: 394 - DNA, 999 bp, Homo sapiens
cccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 395 - protein, 260 aa, Homo sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 396 - DNA, 24 bp, Artificial Sequence
  Synthetic oligonucleotide probe
cagcctacagaataaagatggccc

SEQ ID NO: 397 - DNA, 24 bp, Artificial Sequence
  Synthetic oligonucleotide probe
ggtgcaatgatctgccaggctgat

SEQ ID NO: 398 - DNA, 48 bp, Artificial Sequence
  Synthetic oligonucleotide probe
agaaatacctgtggttcagtccatcccaaacccctgctacaacagcag

SEQ ID NO: 399 - DNA, 2236 bp, Homo sapiens
ggcgccggtgcaccgggcgggctgagcgcctcctgcggcccggcctgcgcgccccggcccgccgcgccgcccacgccccaaccccggcccgcgccccctagcccccgcccgggcccgcgcccgcgcccgcgcccaggtgagcgctccgcccgccgcgaggccccgccccggcccgcccccgccccgccccggccggcgggggaaccgggcggattcctcgcgcgtcaaaccacctgatcccataaaacattcatcctcccggcggcccgcgctgcgagcgccccgccagtccgcgccgccgccgccctcgccctgtgcgccctgcgcgccctgcgcacccgcggcccgagcccagccagagccgggcggagcggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaa

SEQ ID NO: 400 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 401 - DNA, 24 bp, Artificial Sequence
  Synthetic oligonucleotide probe
tggctgccctgcagtacctctacc

SEQ ID NO: 402 - DNA, 24 bp, Artificial Sequence
  Synthetic oligonucleotide probe
ccctgcaggtcattggcagctagg

SEQ ID NO: 403 - DNA, 45 bp, Artificial Sequence
  Synthetic oligonucleotide probe
aggcactgcctgatgacaccttccgcgacctgggcaacctcacac

SEQ ID NO: 404 - DNA, 2738 bp, Homo sapiens
ggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttctt

SEQ ID NO: 405 - protein, 798 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 406 - DNA, 23 bp, Artificial Sequence
  Synthetic oligonucleotide probe
ctgagaacgcgcctgaaactgtg

SEQ ID NO: 407 - DNA, 22 bp, Artificial Sequence
  Synthetic oligonucleotide probe
agcgttgtcattgacatcggcg

SEQ ID NO: 408 - DNA, 50 bp, Artificial Sequence
  Synthetic oligonucleotide probe
ttagttgctccattcaggaggatctacccttcctcctgaaatccgcggaa

SEQ ID NO: 409 - DNA, 1379 bp, Homo sapiens
acccacgcgtccgcccacgcgtccgcccacgcgtccgcccacgcgtccgcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatag

SEQ ID NO: 410 - protein, 360 aa, Homo sapiens
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 411 - DNA, 24 bp, Artificial Sequence
  Synthetic oligonucleotide probe
cacagagccagaagtggcggaatc

SEQ ID NO: 412 - DNA, 25 bp, Artificial Sequence
  Synthetic oligonucleotide probe
ccacatgttcctgctcttgtcctgg

SEQ ID NO: 413 - DNA, 45 bp, Artificial Sequence
  Synthetic oligonucleotide probe
cggtagtgactgtactctagtcctgttttacaccccgtggtgccg

SEQ ID NO: 414 - DNA, 1196 bp, Homo sapiens
cccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggtcaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatattttaa

SEQ ID NO: 415 - protein, 295 aa, Homo sapiens [sequence omitted]

SEQ ID NO: 416 - DNA, 21 bp, Artificial Sequence
  Synthetic oligonucleotide probe
cctggctcgctgctgctgctc

SEQ ID NO: 417 - DNA, 25 bp, Artificial Sequence
  Synthetic oligonucleotide probe
cctcacaggtgcactgcaagctgtc

SEQ ID NO: 418 - DNA, 47 bp, Artificial Sequence
  Synthetic oligonucleotide probe
ctcttcctctttggccagcccgacttctcctacaagcgcagaattgc

SEQ ID NO: 419 - DNA, 1830 bp, Homo sapiens
gtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggccaacatgctcgccaccatgtcgaaccctctgggcgtccttgtggccaatgtgctgtcccctgtgctggtcaagaagggtgaggacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagctgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgaaaa

SEQ ID NO: 420 - protein, 560 aa, Homo sapiens
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLQLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 421 - DNA, 24 bp, Artificial Sequence
  Synthetic oligonucleotide probe
agcttctcagccctcctggagcag

SEQ ID NO: 422 - DNA, 25 bp, Artificial Sequence
  Synthetic oligonucleotide probe
cgggtcaataaacctggacgcttgg

SEQ ID NO: 423 - DNA, 43 bp, Artificial Sequence
  Synthetic oligonucleotide probe
tatgtggaccggaccaagcacttcactgaggccaccaagattg

SEQ ID NO: 424 - DNA, 4313 bp, Homo sapiens
gtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggccgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggacacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcaatggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccgaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtaaaaaaaaaaaaaaaaaaaa

SEQ ID NO: 425 - protein, 1184 aa, Homo sapiens [sequence omitted]

SEQ ID NO: 426 - DNA, 24 bp, Artificial Sequence
  Synthetic oligonucleotide probe
gtaagcacatgcctccagaggtgc

SEQ ID NO: 427 - DNA, 24 bp, Artificial Sequence
  Synthetic oligonucleotide probe
gtgacgtggatgcttgggatgttg

SEQ ID NO: 428 - DNA, 50 bp, Artificial Sequence
  Synthetic oligonucleotide probe
tggacaccttcagtattgatgccaagacaggccaggtcattctgcgtcga

SEQ ID NO: 429 - DNA, 2037 bp, Homo sapiens
cggacgcgtgggcggacgcgtgggggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacaaaaaaaaaaaaaaaaaaaaagggcggccgcgactctagagtcgacctgcagaagcttggccgccatggcccaacttgtttattgcagcttataatg

SEQ ID NO: 430 - protein, 455 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 431 - DNA, 407 bp, Homo sapiens
  unsure 78, 81, 113, 157, 224, 297: unknown base
catgggaagtggagccggagccttccttacactcgccatgagtttcctcatcgactccagcatcatgattacctcccnganactattttttggatttgggtggcttttcttcngcgccaatgtttaaagactatgagatacgtcagtatgttgtacnggtgatcttctccgtgacgtttgccatttcttgcaccatgtttgagctcatcatctttgaaatcttnggagtattgaatagcagctcccgttattttcactggaaaatgaacctgtgtgtaattctgctgatcctggttntcatggtgcctttttacattggctattttattgtgagcaatatccgactactgcataaacaacgactgcttttttcctgtctcttatggctgacctttatgtatttccag

SEQ ID NO: 432 - DNA, 457 bp, Homo sapiens
  unsure 31, 66, 81-82, 84, 122, 184, 187, 232, 241, 400, 424, 427, 434: unknown base
gtgttgcccttggggaggggaaggggagccnggccctttcctaaaatttggccaagggtttctttnttgaattccgggttnngnataccttcccagaaaatattttttggatttggggtagntttttttcatgcgccaattgtttaaagactatgagatacgtcagtatgttgtacaggtgatnttntccgtgacgtttgcattttcttgcaccatgtttgagctcatcatntttgaaatnttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctnttatggctgacctttatgtatttnttntggaaantaggagatccctttcccattctc

SEQ ID NO: 433 - DNA, 20 bp, Artificial Sequence
  Synthetic oligonucleotide probe
aagtggagccggagccttcc

SEQ ID NO: 434 - DNA, 22 bp, Artificial Sequence
  Synthetic oligonucleotide probe
tcgttgtttatgcagtagtcgg

SEQ ID NO: 435 - DNA, 41 bp, Artificial Sequence
  Synthetic oligonucleotide probe
attgtttaaagactatgagatacgtcagtatgttgtacagg

SEQ ID NO: 436 - DNA, 3951 bp, Homo sapiens
ctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaaaaaaaaaaaaaaaaaa

SEQ ID NO: 437 - protein, 1141 aa, Homo sapiens [sequence omitted]

SEQ ID NO: 438 - DNA, 24 bp, Artificial Sequence
  Synthetic oligonucleotide probe
ggctgacaccgcagtgctcttcag

SEQ ID NO: 439 - DNA, 24 bp, Artificial Sequence
  Synthetic oligonucleotide probe
gctgctggggactgcaatgtagct

SEQ ID NO: 440 - DNA, 46 bp, Artificial Sequence
  Synthetic oligonucleotide probe
catcctccatgtctcccatgaggtctctattgctccacgaagcatc

SEQ ID NO: 441 - DNA, 1964 bp, Homo sapiens
cgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataaatttttcacgagaacaaactttgtaaatcttccataagcaaaatgacagctagtgcttgggatcgtacatgttaattttttgaaagataattctaagtgaaatttaaaataaataaatttttaatgacctgggtcttaaggatttaggaaaaatatgcatgctttaattgcatttccaaagtagcatcttgctagacctagatgagtcaggataacagagagataccacatgactccaaaaaaaaaaaaaaa

SEQ ID NO: 442 - protein, 436 aa, Homo sapiens
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 443 - DNA, 25 bp, Artificial Sequence
  Synthetic oligonucleotide probe
cagcaatattcagaagcggcaaggg

SEQ ID NO: 444 - DNA, 28 bp, Artificial Sequence
  Synthetic oligonucleotide probe
catcatggtcatcaccaccatcatcatc

SEQ ID NO: 445 - DNA, 48 bp, Artificial Sequence
  Synthetic oligonucleotide probe
ggttactacaagccaacacaatgtcatggcagtgttggacagtgctgg

SEQ ID NO: 446 - DNA, 3617 bp, Homo sapiens
cagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaagattctttatgtgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaaggaaaa

SEQ ID NO: 447 - protein, 229 aa, Homo sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 448 - DNA, 23 bp, Artificial Sequence
  Synthetic oligonucleotide probe
cccagcagggctgggcgacaaga

SEQ ID NO: 449 - DNA, 23 bp, Artificial Sequence
  Synthetic oligonucleotide probe
gtcttccagtttcatatccaata

SEQ ID NO: 450 - DNA, 43 bp, Artificial Sequence
  Synthetic oligonucleotide probe
ccagaaggagcacggggaagggcagccagatcttgtcgcccat

SEQ ID NO: 451 - DNA, 859 bp, Homo sapiens
ccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctactcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctcagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttataaaaaaaaaaaaaaaaaaaaaa

SEQ ID NO: 452 - protein, 175 aa, Homo sapiens
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 453 - DNA, 550 bp, Homo sapiens
ccagtctgtcgccacctcacttggtgtctgctgtccccgccaggcaagcctggggtgagagcacagaggagtgggccgggaccatgcgggggacgcggctggcgctcctggcgctggtgctggctgcctgcggagagctggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaccaggaaaaaaaaaaaaaaaaa

SEQ ID NO: 454 - protein, 125 aa, Homo sapiens
MRGTRLALLALVLAACGELAPALRCYVCPEPTGVSDCVTIATCTTNETMCKTTLYSREIVYPFQGDSTVTKSCASKCKPSDVDGIGQTLPVSCCNTELCNVDGAPALNSLHCGALTLLPLLSLRL

SEQ ID NO: 455 - DNA, 1518 bp, Homo sapiens
ctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaaaaaaaaaaaaa

SEQ ID NO: 456 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 457 - DNA, 638 bp, Homo sapiens
  unsure 30, 123, 133, 139, 180, 214, 259, 282, 308, 452, 467, 471, 473,509, 556: unknown base
tgtgtttccctgcagtcagaatttgggacngcaggggttcccggacctgattttgcagcggaacgggaaggttttgtgggacccaggttgaaatgacggtcatttttttttctttctccttcnggagtccttntgagangatggttttgggcgcagcgggagctaacccggttttttgtngcgatggtagcggcggttttcggcggccaccttntgctgggagtgagcgccaccttgaatcggttttcaattccaacgntatcaagaacctgcccccaccgntgggcggcgctgcggggcacccaggntttgcagtcagcgccgcgccgggaatcctgtacccgggcgggaataagtaccagaccattgacaattaccagccgtacccgtgcgcagaggacgaggagtgcggcactgatgagtactgcgctagtcccacccgcggaggggangcgggcgtgcaaatntgtntngcctgcaggaagcgccgaaaacgctgcatgcgtcangctatgtgctgccccgggaattactgcaaaaatggaatatgtgtgtnttctgatcaaaatcatttccgaggagaaattgaggaaaccatcactgaaagctttggtaatgatcatagcaccttggatggg

SEQ ID NO: 458 - DNA, 4040 bp, Homo sapiens
gaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagtctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaaaaaaaaaaaaaa

SEQ ID NO: 459 - protein, 747 aa, Homo sapiens [sequence omitted]

SEQ ID NO: 460 - DNA, 24 bp, Artificial Sequence
  Synthetic oligonucleotide probe
actccccaggctgttcacactgcc

SEQ ID NO: 461 - DNA, 24 bp, Artificial Sequence
  Synthetic oligonucleotide probe
gatcagccagccaataccagcagc

SEQ ID NO: 462 - DNA, 50 bp, Artificial Sequence
  Synthetic oligonucleotide probe
gtggtgatgatagaatgctttgccgaatgaaaggagtcaacagctatccc

SEQ ID NO: 463 - DNA, 1818 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaa

SEQ ID NO: 464 - protein, 300 aa, Homo sapiens
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 465 - DNA, 1547 bp, Homo sapiens
cggcggcggctgcgggcgcgaggtgaggggcgcgaggtgaggggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacga

SEQ ID NO: 466 - protein, 414 aa, Homo sapiens
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 467 - DNA, 1071 bp, Homo sapiens
tcgggccagaattcggcacgaggcggcacgagggcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcagcc

SEQ ID NO: 468 - protein, 270 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHHPPPQRPEETSAQGFRQLLELNLLGTYTLTKLALPYLRKSQGNVINISSLVGAIGQAQAVPYVATKGAVTAMTKALALDESPYGVRVNCISPGNIWTPLWEELAALMPDPRATIREGMLAQPLGRMGQPAEVGAAAVFLASEANFCTGIELLVTGGAELGYGCKASRSTPVDAPDIPS

SEQ ID NO: 469 - DNA, 687 bp, Homo sapiens
aggcgggcagcagctgcaggctgaccttgcagcttggcggaatggactggcctcacaacctgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaagtaaacactgacttttgaaagcaag

SEQ ID NO: 470 - protein, 180 aa, Homo sapiens
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 471 - DNA, 2368 bp, Homo sapiens
gcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccagcttctctaacgatgtctggaatggctggtctttttagcatctctggcaagatatggcatcttcacaactatttcacagtgactcttggaattcctgcttggtgttcttatgtgtttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttcttt

SEQ ID NO: 472 - protein, 349 aa, Homo sapiens
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 473 - DNA, 24 bp, Artificial Sequence
  Synthetic oligonucleotide probe
gtccagcccatgaccgcctccaac

SEQ ID NO: 474 - DNA, 24 bp, Artificial Sequence
  Synthetic oligonucleotide probe
ctctcctcatccacaccagcagcc

SEQ ID NO: 475 - DNA, 44 bp, Artificial Sequence
  Synthetic oligonucleotide probe
gtggatgctgaaattttacgccccatggtgtccatcctgccagc

SEQ ID NO: 476 - DNA, 2478 bp, Homo sapiens
atctggttgaactacttaagcttaatttgttaaactccggtaagtacctagcccacatgatttgactcagagattctcttttgtccacagacagtcatctcaggggcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaaaaaaaaaaaaaaaaaaaaaaaaaaaaaaaaa

SEQ ID NO: 477 - protein, 201 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 478 - DNA, 27 bp, Artificial Sequence
  Synthetic oligonucleotide probe
gtccacagacagtcatctcaggagcag

SEQ ID NO: 479 - DNA, 20 bp, Artificial Sequence
  Synthetic oligonucleotide probe
acaagtgtcttcccaacctg

SEQ ID NO: 480 - DNA, 24 bp, Artificial Sequence
  Synthetic oligonucleotide probe
atcctcccagagccatggtacctc

SEQ ID NO: 481 - DNA, 51 bp, Artificial Sequence
  Synthetic oligonucleotide probe
ccaaggatagctgttgtttcagagaaaggatcgtgtgctgcatctcctcct

SEQ ID NO: 482 - DNA, 3819 bp, Homo sapiens
ggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagccaggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcgcctagcaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 483 - protein, 693 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 484 - DNA, 516 bp, Homo sapiens
  unsure 68, 70, 84, 147: unknown base
tgcctggcctgccttgtcaacaatgccgcttactctgcttccaggttgccctgccttgcagaggaaancntcgggactacaccntcaagtgcacatgaacctgctgctggccgtcttcctgctggacacgagcttcctgctcagcgnagccggtggccctgacaggctctgaaggctggctgccgagccagtgccatcttcctgcacttctcctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatgg

SEQ ID NO: 485 - DNA, 22 bp, Artificial Sequence
  Synthetic oligonucleotide probe
ggcattggagcagtgctgggtg

SEQ ID NO: 486 - DNA, 24 bp, Artificial Sequence
  Synthetic oligonucleotide probe
tggaggcctagatgcggctggacg

SEQ ID NO: 487 - DNA, 2849 bp, Homo sapiens
  unsure 2715: unknown base
cggacgcgtgggcggacgcgtgggcggacgcgtgggcggacgcgtgggctggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcatgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatngtgcctaggttatgtggtgactatttgaatcaaaaatgtattgaatcatcaaataaaagaatgtggctattttggggagaaaattaaaaaaaaaaaaaaaaaaaaaggtttagggataacagggtaatgcggcc

SEQ ID NO: 488 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 489 - DNA, 21 bp, Artificial Sequence
  Synthetic oligonucleotide probe
acttctcagtgtccataaggg

SEQ ID NO: 490 - DNA, 40 bp, Artificial Sequence
  Synthetic oligonucleotide probe
gaactaaagagaaccgataccattttctggccaggttgtc

SEQ ID NO: 491 - DNA, 20 bp, Artificial Sequence
  Synthetic oligonucleotide probe
caccacagcgtttaaccagg

SEQ ID NO: 492 - DNA, 20 bp, Artificial Sequence
  Synthetic oligonucleotide probe
acaacaggcacagttcccac

SEQ ID NO: 493 - DNA, 21 bp, Artificial Sequence
  Synthetic oligonucleotide probe
ggcggaatccaacctgagtag

SEQ ID NO: 494 - DNA, 20 bp, Artificial Sequence
  Synthetic oligonucleotide probe
gcggctatcctcctgtgctc

SEQ ID NO: 495 - DNA, 3283 bp, Homo sapiens
cccatctcaagctgatcttggcacctctcatgctctgctctcttcaaccagacctctacattccattttggaagaagactaaaaatggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggc

SEQ ID NO: 496 - protein, 1049 aa, Homo sapiens
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 497 - DNA, 4199 bp, Homo sapiens
gggtaccattctgcgctgctgcaagttacggaatgaaaaattagaacaacagaaacatggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagtctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggacccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttttgagggtcaggagtccaggcccagcataactgggtcctctgctcagggtgtctcagaggctgcaatgtaggtgttcaccagagacataggcatcactggggtcacactcatgtggttgttttctggattcaattcctcctgggctattggccaaaggctatactcatgtaagccatgcgagcctctcccacaaggcagcttgcttcatcagagctagcaaaaaagagaggttgctagcaagatgaagtcacaatcttttgtaatcgaatcaaaaaagtgatatctcatcactttggccatattctatttgttagaagtaaaccacaggtcccaccagctccatgggagtgaccacctcagtccagggaaaacagctgaagaccaagatggtgagctctgattgcttcagttggtcatcaactattttcccttgactgctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcattttacaaaaaaaaaaaaaaaa

SEQ ID NO: 498 - protein, 1041 aa, Homo sapiens [sequence omitted]

SEQ ID NO: 499 - DNA, 20 bp, Artificial Sequence
  Synthetic oligonucleotide probe
taaagacccagctgtgaccg

SEQ ID NO: 500 - DNA, 20 bp, Artificial Sequence
  Synthetic oligonucleotide probe
atccatgagcctctgatggg

SEQ ID NO: 501 - DNA, 45 bp, Artificial Sequence
  Synthetic oligonucleotide probe
atttatgtctcgaggaaagggactggttaccagggcagccagttc

SEQ ID NO: 502 - DNA, 21 bp, Artificial Sequence
  Synthetic oligonucleotide probe
gccgagacaaaaacgttctcc

SEQ ID NO: 503 - DNA, 24 bp, Artificial Sequence
  Synthetic oligonucleotide probe
catccatgttctcatccattagcc

SEQ ID NO: 504 - DNA, 46 bp, Artificial Sequence
  Synthetic oligonucleotide probe
tcgacaacctcatgcagagcatcaaccaaagcaagaaaacagtatt

SEQ ID NO: 505 - DNA, 1738 bp, Homo sapiens
ccaggtccaactgcacctcggttctatcgattgaattccccggggatcctctagagatccctcgacctcgacccacgcgtccgccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcatcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtgaaaaaaaaaaaaaaaaaaaaaaaaaaaaaaaaaaaaaaaaaagggcggccgcgactctagagtcgacctgcagaagcttggccgccatggcccaacttgtttattgcagcttataatggttacaaat

SEQ ID NO: 506 - protein, 273 aa, Homo sapiens [sequence omitted]

SEQ ID NO: 507 - DNA, 1700 bp, Homo sapiens
gccaggcaggtgggcctcaggaggtgcctccaggcggccagtgggcctgaggccccagcaagggctagggtccatctccagtcccaggacacagcagcggccaccatggccacgcctgggctccagcagcatcagagcagcccctgtggttggcagcaaagttcagcttggctgggcccgctgtgaggggcttcgcgctacgccctgcggtgtcccgagggctgaggtctcctcatcttctccctagcagtggatgagcaacccaacgggggcccggggaggggaactggccccgagggagaggaaccccaaagccacatctgtagccaggatgagcagtgtgaatccaggcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcatcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgctccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtggaccctcagctgagggaaggtacgagctccctgctggagcctgggacccatggcacaggccaggcagcccggaggctgggtggggcctcagtgggggctgctgcctgacccccagcacaataaaaatgaaacgtg

SEQ ID NO: 508 - protein, 273 aa, Homo sapiens [sequence omitted]

SEQ ID NO: 509 - DNA, 1538 bp, Homo sapiens
cccacgcgtccgaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtg

SEQ ID NO: 510 - protein, 273 aa, Homo sapiens
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 511 - DNA, 21 bp, Artificial Sequence
  Synthetic oligonucleotide probe
tggagcagcaatatgccagcc

SEQ ID NO: 512 - DNA, 22 bp, Artificial Sequence
  Synthetic oligonucleotide probe
ttttccactcctgtcgggttgg

SEQ ID NO: 513 - DNA, 46 bp, Artificial Sequence; identical to SEQ ID NO: 5
  Synthetic oligonucleotide probe

SEQ ID NO: 514 - DNA, 2690 bp, Homo sapiens
  unsure 2039-2065: unknown base
ggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtgtttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtannnnnnnnnnnnnnnnnnnnnnnnnnnttgtttttccttttgactcctgctcccattaggagcaggaatggcagtaataaaagtctgcactttggtcatttcttttcctcagaggaagcccgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgca

SEQ ID NO: 515 - protein, 364 aa, Homo sapiens
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 516 - DNA, 255 bp, Homo sapiens
  unsure 36, 38, 88, 118, 135, 193, 213, 222: unknown base
aaaaccctgtattttttacaatgcaaatagacaatnancctggaggtctttgaattaggtattatagggatggtggggttgatttttnttcctggaggcttttggctttggactctcnctttctcccacagagcncttcgaccatcactgcccctgggtggggaattgtgttggaaagaggaactaccgctanttctacctcttcatcctttntctctcccncctcacaatctatgtcttcgccttcaacatcgt

SEQ ID NO: 517 - DNA, 24 bp, Artificial Sequence
  Synthetic oligonucleotide probe
caacgtgatttcaaagctgggctc

SEQ ID NO: 518 - DNA, 20 bp, Artificial Sequence
  Synthetic oligonucleotide probe
gcctcgtatcaagaatttcc

SEQ ID NO: 519 - DNA, 18 bp, Artificial Sequence
  Synthetic oligonucleotide probe
agtggaagtcgacctccc

SEQ ID NO: 520 - DNA, 24 bp, Artificial Sequence
  Synthetic oligonucleotide probe
ctcacctgaaatctctcatagccc

SEQ ID NO: 521 - DNA, 50 bp, Artificial Sequence
  Synthetic oligonucleotide probe
cgcaaaacccattttgggagcaggaattccaatcatgtctgtgatggtgg

SEQ ID NO: 522 - DNA, 1679 bp, Homo sapiens
gttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaaaaaaaaa

SEQ ID NO: 523 - protein, 344 aa, Homo sapiens
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 524 - DNA, 503 bp, Homo sapiens
gaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagag

SEQ ID NO: 525 - DNA, 2602 bp, Homo sapiens
atggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtcactcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattactgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcc

SEQ ID NO: 526 - protein, 736 aa, Homo sapiens [sequence omitted]

SEQ ID NO: 527 - DNA, 4308 bp, Homo sapiens
  unsure 1478, 3978, 4057-4058, 4070: unknown base
gcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggtaggtgggcgcccgggggaggcgcgggcggggagtcgggctcggggcgagtcagcgccagcccggagggggcgcggggcgcaggtggctcggcgcggcgggcggcccggagggtgggcgggggcagaagggcgcggtgcctgggacccgggacccgcgggcagcccccggggcggcacacggcgcgagctgggcagcggcctccagccaagcccgtccccgcaggctgcaccttcggcgggaaggtctatgccttggacgagacgtggcacccggacctaggggagccattcggggtgatgcgctgcgtgctgtgcgcctgcgaggcgcagtggggtcgccgtaccaggggccctggcagggtcagctgcaagaacatcaaaccagagtgcccaaccccggcctgtgggcagccgcgccagctgccgggacactgctgccagacctgcccccaggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctgtccccagagaccttcagtgccatcctgactctagaaggcccccaccagcagggcgtagggggcatcaccctgctcactctcagtgacacagaggactccttgcattttttgctgctcttccgaggccttgcaggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctaatgccctgatcccagtccaaacgggtgctgccggctcagccagcctcactctgctaggaaatggcnccctgatcctccaggtgcaattggtagggacaaccagtgaggtggtggccatgacactggaaaccaagcctcagcggagggatcagcccactgtcctgtgccacatggctggcctatcctcccctgcccccaggccgtgggtatctgccctgggctggggtgcccgaggggctcatatgctgctgcagaatgagctcttcctgaacgtgggcaccaaggacttcccagacggagagcttcgggggcaacgtggctgccctgccctactgtggggcatagcgcccgccctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcttccctgatgatcaccaccaaggtagccccagaggggagctccgagggcagcctctcctcccaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctggctgctattttgatggtgaccggagctggcgggcagcgggtacgcggtggcaccccgttgtgcccccctttggcttaattaagtgtgctgtctgcacctgcaagcaggggggcactggagaggtgcactgtgagaaggtgcagtgtccccggctggcctgtgcccagcctgtgcgtgtcaaccccaccgactgctgcaaacagtgtccaggtgaggcccacccccagctgggggaccccatgcaggctgatgggccccggggctgccgttttgctgggcagtggttcccagagagtcagagctggcacccctcagtgcccccgtttggagagatgagctgtatcacctgcagatgtggggtaagtggggagcagaggcttgtgtgaggtgggtactgggagcctggtctggagtagggagaccttcccagggaggtccctgaagaagctgaaggtcactgtgtcccagtgcctctgggggacactcagtgtctgctctgtcttgtaccaggcaggggtgcctcactgtgagcgggatgactgttcactgccactgtcctgtggctcggggaaggagagtcgatgctgttcccgctgcacggcccaccggcggcgtaagtgagggagtccagggtcagcagctgtgagtggagggctcacctgcctgtgggactcctgatcagggaagggagcactcactgtgtgcaggaacagtgcagcctgcctcacaagtgccattccaatccaccctcacagcaacctggtggaattgttatttatgaccttttctttacaaatgagatttctgaagctcagagaaattaagcaacgagatgaaggtcacccagctgtgtgcactgacctgtttagaaaatactggcctttctgggaccaaggcagggatgctttgccctgccctctatgcctctctgtgcctctccactccctctcccctcctccaacattccctcccttctgtctccagcagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcttcctgtacataatgtcactggcttgttgggatttttaatttatcttcactcagcaccaagggccccggacactccactcctgctgcccctgagctgagcagagtcattattggagagttttgtatttattaaaacatttctttttcagtctttgggcatgaggttggctctttgtggccaggaacctgagtggggcctggtggagaaggggcngagagtaggaggtgagagagaggagctctgacacttggggagctgaaagagacctggagaggcagaggatagcgtggcnnttggctggcatncctgggttccgcagaggggctggggatggttcttgagatggtctagagactcaagaatttagggaagtagaagcaggattttgactcaagtttagtttcccacatcgctggcctgtttgctgacttcatgtttgaagttgctccagagagagaatcaaaggtgtcaccagcccctctctccctccttcccttcccttccctttctttccctcccctcccctcccctcccctcccctcc

SEQ ID NO: 528 - DNA, 1285 bp, Homo sapiens
ggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtaaggaacatcttccgaacccccatccctacccctggctgagctgggctgatccctgttgacttttccctttgccaagggtcagagcagggaaggtgagcctatcctgtcacctagtgaacaaactgcccctcctttctttcttcttttcttcctccctccctccctttcttccccttttccttccttccttcctcttattcttctagtaggtttcatagacacctactgtgtgccaggtccagtgggggaattcggagatataagtttccgagccattgccacaggaagcgttcagtgtcgatgggttcatggacctagataggctgataacaaagctcacaagagggtcctgaggattcaggagagacttatggagccagcaaagtcttcctgaagagattgcatttgagccaggtcctgtag

SEQ ID NO: 529 - DNA, 1380 bp, Homo sapiens
atgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggacc

SEQ ID NO: 530 - DNA, 39 bp, Artificial Sequence
  Synthetic oligonucleotide probe
gaagcagtgcagccagcagtagagaggcacctgctaaga

SEQ ID NO: 531 - DNA, 24 bp, Artificial Sequence
  Synthetic oligonucleotide probe
acgcagctggagctggtcttagca

SEQ ID NO: 532 - DNA, 24 bp, Artificial Sequence
  Synthetic oligonucleotide probe
ggtactggacccctagggccacaa

SEQ ID NO: 533 - DNA, 21 bp, Artificial Sequence
  Synthetic oligonucleotide probe
cctcccagccgagaccagtgg

SEQ ID NO: 534 - DNA, 21 bp, Artificial Sequence
  Synthetic oligonucleotide probe
ggtcctataagggccaagacc

SEQ ID NO: 535 - DNA, 44 bp, Artificial Sequence
  Synthetic oligonucleotide probe
gactagttctagatcgcgagcggccgcccttttttttttttttt

SEQ ID NO: 536 - DNA, 16 bp, Artificial Sequence
  Synthetic oligonucleotide probe
cggacgcgtgggtcga

SEQ ID NO: 537 - DNA, 21 bp, Artificial Sequence
  Synthetic oligonucleotide probe
cggccgtgatggctggtgacg

SEQ ID NO: 538 - DNA, 20 bp, Artificial Sequence
  Synthetic oligonucleotide probe
ggcagactccttcctatggg

SEQ ID NO: 539 - DNA, 21 bp, Artificial Sequence
  Synthetic oligonucleotide probe
ggcacttcatggtccttgaaa

SEQ ID NO: 540 - DNA, 22 bp, Artificial Sequence
  Synthetic oligonucleotide probe
cggatgtgtgtgaggccatgcc

SEQ ID NO: 541 - DNA, 24 bp, Artificial Sequence
  Synthetic oligonucleotide probe
gaaagtaaccacggaggtcaagat

SEQ ID NO: 542 - DNA, 21 bp, Artificial Sequence
  Synthetic oligonucleotide probe
cctcctccgagactgaaagct

SEQ ID NO: 543 - DNA, 22 bp, Artificial Sequence
  Synthetic oligonucleotide probe
tcgcgttgctttttctcgcgtg

SEQ ID NO: 544 - DNA, 17 bp, Artificial Sequence
  Synthetic oligonucleotide probe
gcgtgcgtcaggttcca

SEQ ID NO: 545 - DNA, 19 bp, Artificial Sequence
  Synthetic oligonucleotide probe
cgttcgtgcagcgtgtgta

SEQ ID NO: 546 - DNA, 22 bp, Artificial Sequence
  Synthetic oligonucleotide probe
cttcctcaccacctgcgacggg

SEQ ID NO: 547 - DNA, 23 bp, Artificial Sequence
  Synthetic oligonucleotide probe
ggtaggcggtcctatagatggtt

SEQ ID NO: 548 - DNA, 23 bp, Artificial Sequence
  Synthetic oligonucleotide probe
agatgtggatgaatgcagtgcta

SEQ ID NO: 549 - DNA, 24 bp, Artificial Sequence
  Synthetic oligonucleotide probe
atcaacaccgccggcagttactgg

SEQ ID NO: 550 - DNA, 23 bp, Artificial Sequence
  Synthetic oligonucleotide probe
acagagtgtaccgtctgcagaca

SEQ ID NO: 551 - DNA, 19 bp, Artificial Sequence
  Synthetic oligonucleotide probe
agcctcctggtgcactcct

SEQ ID NO: 552 - DNA, 25 bp, Artificial Sequence
  Synthetic oligonucleotide probe
cgactccctgagcgagcagatttcc

SEQ ID NO: 553 - DNA, 20 bp, Artificial Sequence
  Synthetic oligonucleotide probe
gctgggcagtcacgagtctt

SEQ ID NO: 554 - DNA, 24 bp, Artificial Sequence
  Synthetic oligonucleotide probe
aatcctccatctcagatcttccag

SEQ ID NO: 555 - DNA, 21 bp, Artificial Sequence
  Synthetic oligonucleotide probe
cctcagcggtaacagccggcc

SEQ ID NO: 556 - DNA, 15 bp, Artificial Sequence
  Synthetic oligonucleotide probe
tgggccaagggctgc

SEQ ID NO: 557 - DNA, 22 bp, Artificial Sequence
  Synthetic oligonucleotide probe
tggtggataaccaacaagatgg

SEQ ID NO: 558 - DNA, 34 bp, Artificial Sequence
  Synthetic oligonucleotide probe
gagtctgcatccacaccactcttaaagttctcaa

SEQ ID NO: 559 - DNA, 24 bp, Artificial Sequence
  Synthetic oligonucleotide probe
caggtgctcttttcagtcatgttt

SEQ ID NO: 560 - DNA, 21 bp, Artificial Sequence
  Synthetic oligonucleotide probe
tggccattctcaggacaagag

SEQ ID NO: 561 - DNA, 26 bp, Artificial Sequence
  synthetic oligonucleotide probe
cagtaatgccatttgcctgcctgcat

SEQ ID NO: 562 - DNA, 19 bp, Artificial Sequence
  Synthetic oligonucleotide probe
tgcctggaatcacatgaca

SEQ ID NO: 563 - DNA, 20 bp, Artificial Sequence
  synthetic oligonucleotide probe
tgtggcacagacccaatcct

SEQ ID NO: 564 - DNA, 21 bp, Artificial Sequence
  Synthetic oligonucleotide probe
gaccctgaaggcctccggcct

SEQ ID NO: 565 - DNA, 23 bp, Artificial Sequence
  Synthetic oligonucleotide probe
gagagagggaaggcagctatgtc

SEQ ID NO: 566 - DNA, 21 bp, Artificial Sequence
  Synthetic oligonucleotide probe
cagcccctctctttcacctgt

SEQ ID NO: 567 - DNA, 25 bp, Artificial Sequence
  Synthetic oligonucleotide probe
ccatcctgtgcagctgacacacagc

SEQ ID NO: 568 - DNA, 20 bp, Artificial Sequence
  Synthetic oligonucleotide probe
gccaggctatgaggctcctt

SEQ ID NO: 569 - DNA, 23 bp, Artificial Sequence
  Synthetic oligonucleotide probe
ttcaagttcctgaagccgattat

SEQ ID NO: 570 - DNA, 23 bp, Artificial Sequence
  Synthetic oligonucleotide probe
ccaacttccctccccagtgccct

SEQ ID NO: 571 - DNA, 26 bp, Artificial Sequence
  Synthetic oligonucleotide probe
ttggggaaggtagaatttccttgtat

SEQ ID NO: 572 - DNA, 20 bp, Artificial Sequence
  Synthetic oligonucleotide probe
cccttctgcctcccaattct

SEQ ID NO: 573 - DNA, 24 bp, Artificial Sequence
  Synthetic oligonucleotide probe
tctcctccgtccccttcctccact

SEQ ID NO: 574 - DNA, 20 bp, Artificial Sequence
  Synthetic oligonucleotide probe
tgagccactgccttgcatta

SEQ ID NO: 575 - DNA, 20 bp, Artificial Sequence
  Synthetic oligonucleotide probe
tctgcagacgcgatggataa

SEQ ID NO: 576 - DNA, 26 bp, Artificial Sequence
  Synthetic oligonucleotide probe
ccgaaaataaaacatcgccccttctg

SEQ ID NO: 577 - DNA, 20 bp, Artificial Sequence
  Synthetic oligonucleotide probe
cacgtggcctttcacactga

SEQ ID NO: 578 - DNA, 25 bp, Artificial Sequence
  Synthetic oligonucleotide probe
acttgtgacagcagtatgctgtctt

SEQ ID NO: 579 - DNA, 26 bp, Artificial Sequence
  Synthetic oligonucleotide probe
aagcttctgttcaatcccagcggtcc

SEQ ID NO: 580 - DNA, 22 bp, Artificial Sequence
  Synthetic oligonucleotide probe
atgcacaggctttttctggtaa

SEQ ID NO: 581 - DNA, 22 bp, Artificial Sequence
  Synthetic oligonucleotide probe
gcaggaaaccttcgaatctgag

SEQ ID NO: 582 - DNA, 29 bp, Artificial Sequence
  Synthetic oligonucleotide probe
acacctgaggcacctgagagaggaactct

SEQ ID NO: 583 - DNA, 21 bp, Artificial Sequence
  Synthetic oligonucleotide probe
gacagcccagtacacctgcaa

SEQ ID NO: 584 - DNA, 21 bp, Artificial Sequence
  Synthetic oligonucleotide probe
gacggctggatctgtgagaaa

SEQ ID NO: 585 - DNA, 21 bp, Artificial Sequence
  Synthetic oligonucleotide probe
cacaactgctgaccccgccca

SEQ ID NO: 586 - DNA, 20 bp, Artificial Sequence
  Synthetic oligonucleotide probe
ccaggatacgacatgctgca

SEQ ID NO: 587 - DNA, 24 bp, Artificial Sequence
  Synthetic oligonucleotide probe
aaactccaacctgtatcagatgca

SEQ ID NO: 588 - DNA, 25 bp, Artificial Sequence
  Synthetic oligonucleotide probe
cccccaagcccttagactctaagcc

SEQ ID NO: 589 - DNA, 19 bp, Artificial Sequence
  Synthetic oligonucleotide probe
gacccggcaccttgctaac

SEQ ID NO: 590 - DNA, 21 bp, Artificial Sequence
  Synthetic oligonucleotide probe
ggacggtcagtcaggatgaca

SEQ ID NO: 591 - DNA, 25 bp, Artificial Sequence
  Synthetic oligonucleotide probe
ttcggcatcatctcttccctctccc

SEQ ID NO: 592 - DNA, 25 bp, Artificial Sequence
  Synthetic oligonucleotide probe
acaaaaaaaagggaacaaaatacga

SEQ ID NO: 593 - DNA, 28 bp, Artificial Sequence
  Synthetic oligonucleotide probe
ctttgaatagaagacttctggacaattt

SEQ ID NO: 594 - DNA, 30 bp, Artificial Sequence
  Synthetic oligonucleotide probe
ttgcaactgggaatataccacgacatgaga

SEQ ID NO: 595 - DNA, 26 bp, Artificial Sequence
  Synthetic oligonucleotide probe
tagggtgctaatttgtgctataacct

SEQ ID NO: 596 - DNA, 20 bp, Artificial Sequence
  Synthetic oligonucleotide probe
ggctctgagtctctgcttga

SEQ ID NO: 597 - DNA, 25 bp, Artificial Sequence
  Synthetic oligonucleotide probe
tccaacaaccattttcctctggtcc

SEQ ID NO: 598 - DNA, 23 bp, Artificial Sequence
  Synthetic oligonucleotide probe
aagcagtagccattaacaagtca

SEQ ID NO: 599 - DNA, 20 bp, Artificial Sequence
  Synthetic oligonucleotide probe
caagcgtccaggtttattga

SEQ ID NO: 600 - DNA, 20 bp, Artificial Sequence
  Synthetic oligonucleotide probe
gactacaaggcgctcagcta

SEQ ID NO: 601 - DNA, 21 bp, Artificial Sequence
  Synthetic oligonucleotide probe
ccggctgggtctcactcctcc

SEQ ID NO: 602 - DNA, 19 bp, Artificial Sequence
  Synthetic oligonucleotide probe
cgttcgtgcagcgtgtgta

SEQ ID NO: 603 - DNA, 22 bp, Artificial Sequence
  Synthetic oligonucleotide probe
cttcctcaccacctgcgacggg

SEQ ID NO: 604 - DNA, 23 bp, Artificial Sequence
  Synthetic oligonucleotide probe
ggtaggcggtcctatagatggtt

SEQ ID NO: 605 - DNA, 23 bp, Artificial Sequence
  Synthetic oligonucleotide probe
agatgtggatgaatgcagtgcta

SEQ ID NO: 606 - DNA, 24 bp, Artificial Sequence
  Synthetic oligonucleotide probe
atcaacaccgccggcagttactgg

SEQ ID NO: 607 - DNA, 23 bp, Artificial Sequence
  Synthetic oligonucleotide probe
acagagtgtaccgtctgcagaca

SEQ ID NO: 608 - DNA, 19 bp, Artificial Sequence
  Synthetic oligonucleotide probe
agcctcctggtgcactcct

SEQ ID NO: 609 - DNA, 25 bp, Artificial Sequence
  Synthetic oligonucleotide probe
cgactccctgagcgagcagatttcc

SEQ ID NO: 610 - DNA, 20 bp, Artificial Sequence
  Synthetic oligonucleotide probe
gctgggcagtcacgagtctt

SEQ ID NO: 611 - DNA, 2840 bp, Homo Sapien
cccacgcgtccgagccgcccgagaattagacacactccggacgcggccaaaagcaaccgagaggaggggaggcaaaaacaccgaaaaacaaaaagagagaaacaacacccaacaactggggtggggggaagaaagaaagaaaagaaacccacccacccaccaaaaaaaaaaaaaaaaaaaaaaaaaaaaaaaaaaaaatcctgtggcgcgccgcctggttcccgggaagactcgccagcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgctgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgcttgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaaccttttgtttttaaattgacctgccaaggtagctgaagaccttttagacagttccatctttttttttaaattttttctgcctatttaaagacaaattatgggacgtttgtcaaaaaaaaaaaaaaaaaaaaaaaaaaa

SEQ ID NO: 612 - protein, 352 aa, Homo Sapien [sequence omitted]

SEQ ID NO: 613 - DNA, 1797 bp, Homo Sapien
agtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcattga

SEQ ID NO: 614 - protein, 520 aa, Homo Sapien
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 615 - DNA, 647 bp, Homo Sapien
cccacgcgtccgaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaaaaaaaaaaaaa

SEQ ID NO: 616 - protein, 98 aa, Homo Sapien
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 617 - DNA, 2558 bp, Homo Sapien
cccacgcgtccgcggacgcgtgggctggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttacataattttacacagataccacatttagcaggaacagaacaaaactttcagcttgcaaagcaaattcaatcccagtggaaagaatttggcctggattctgttgagctagctcattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagacggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacgagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattttttagagaatccgtattgaatttgtgtggtatgtcactcagaaagaatcgtaatgggtatattgataaattttaaaattggtatatttgaaataaagttgaatattatatataa

SEQ ID NO: 618 - protein, 750 aa, Homo Sapien [sequence omitted]

SEQ ID NO: 619 - DNA, 24 bp, Artificial Sequence
  Synthetic oligonucleotide probe
agatgtgaaggtgcaggtgtgccg

SEQ ID NO: 620 - DNA, 25 bp, Artificial Sequence
  Synthetic oligonucleotide probe
gaacatcagcgctcccggtaattcc

SEQ ID NO: 621 - DNA, 46 bp, Artificial Sequence
  Synthetic oligonucleotide probe
ccagcctttgaatggtacaaaggagagaagaagctcttcaatggcc

SEQ ID NO: 622 - DNA, 25 bp, Artificial Sequence
  Synthetic oligonucleotide probe
ccaaactcacccagtgagtgtgagc

SEQ ID NO: 623 - DNA, 25 bp, Artificial Sequence
  Synthetic oligonucleotide probe
tgggaaatcaggaatggtgttctcc

SEQ ID NO: 624 - DNA, 50 bp, Artificial Sequence
  Synthetic Oligonucleotide probe
cttgttttcaccattgggctaactttgctgctaggagttcaagccatgcc

What is claimes is:

1. An isolated polypeptide comprising:
   (a) the amino acid sequence of the polypeptide of SEQ ID NO:352;
   (b) the amino acid sequence of the polypeptide of SEQ ID NO:352, lacking its associated signal peptide; or
   (d) the amino acid sequence of the polypeptide encoded by the full-length coding sequence of the cDNA deposited under ATCC accession number 209905.

2. The isolated polypeptide of claim 1 comprising the amino acid sequence of the polypeptide of SEQ ID NO:352.

3. The isolated polypeptide of claim 1 comprising the amino acid sequence of the polypeptide of SEQ ID NO:352, lacking its associated signal peptide.

4. The isolated polypeptide of claim 1 comprising the amino acid sequence of the polypeptide encoded by the full-length coding sequence of the cDNA deposited under ATCC accession number 209905.

5. A chimeric polypeptide comprising a polypeptide according to claim 1 fused to a heterologous polypeptide.

6. The chimeric polypeptide of claim 5, wherein said heterologous polypeptide is an epitope tag or an Fc region of an immunoglobulin.

* * * * *

UNITED STATES PATENT AND TRADEMARK OFFICE
CERTIFICATE OF CORRECTION

PATENT NO.         : 7,220,835 B2  
APPLICATION NO.    : 10/160502  
DATED              : May 22, 2007  
INVENTOR(S)        : Kevin P. Baker et al.

Page 1 of 1

It is certified that error appears in the above-identified patent and that said Letters Patent is hereby corrected as shown below:

On the title page item [63] the related U.S. application data should read,
-- Continuation of application 09/918,585, filed on Jul. 30, 2001, now abandoned, which is a continuation of application No. PCT/US00/04341, filed on Feb. 18, 2000, which is a continuation-in-part of application No. 09/380,138, filed as application No. PCT/US99/05028 on Mar. 8, 1999, now abandoned. --

Provisional application No. 60/094,651, filed on Jul. 30, 1998 and 60/087,106 filed May 28, 1998.--

Signed and Sealed this

Twenty-fifth Day of December, 2007

JON W. DUDAS  
*Director of the United States Patent and Trademark Office*